(12) United States Patent
Hymus et al.

(10) Patent No.: US 10,113,177 B2
(45) Date of Patent: Oct. 30, 2018

(54) YIELD IMPROVEMENT IN PLANTS

(71) Applicant: Koch Biological Solutions, LLC, Hayward, CA (US)

(72) Inventors: Graham J. Hymus, Castro Valley, CA (US); T. Lynne Reuber, San Mateo, CA (US); Colleen M. Marion, San Mateo, CA (US); Oliver J. Ratcliffe, Oakland, CA (US); Jeffrey M. Libby, Cupertino, CA (US)

(73) Assignee: Koch Biological Solutions, LLC, Hayward, CA (US)

( * ) Notice: Subject to any disclaimer, the term of this patent is extended or adjusted under 35 U.S.C. 154(b) by 313 days.

(21) Appl. No.: 15/025,367

(22) PCT Filed: Oct. 13, 2014

(86) PCT No.: PCT/US2014/060267
§ 371 (c)(1),
(2) Date: Mar. 28, 2016

(87) PCT Pub. No.: WO2015/057571
PCT Pub. Date: Apr. 23, 2015

(65) Prior Publication Data
US 2016/0333369 A1    Nov. 17, 2016

(51) Int. Cl.
*A01H 5/00*    (2018.01)
*C12N 15/82*   (2006.01)
*C07K 14/415*  (2006.01)

(52) U.S. Cl.
CPC ........ *C12N 15/8269* (2013.01); *C07K 14/415* (2013.01); *C12N 15/8223* (2013.01); *C12N 15/8261* (2013.01); *C12N 15/8273* (2013.01); *Y02A 40/146* (2018.01)

(58) Field of Classification Search
None
See application file for complete search history.

(56) References Cited

U.S. PATENT DOCUMENTS

| | | | | |
|---|---|---|---|---|
| 2003/0229915 A1* | 12/2003 | Keddie | ........... | C07K 14/415 800/278 |
| 2006/0195944 A1* | 8/2006 | Heard | ........... | C07K 14/415 800/287 |
| 2007/0022495 A1* | 1/2007 | Reuber | ........... | C07K 14/415 800/279 |
| 2014/0041073 A1* | 2/2014 | Marion | ........... | C12N 15/8269 800/260 |
| 2015/0247159 A1* | 9/2015 | Hymus | ........... | C12N 15/8269 800/275 |

OTHER PUBLICATIONS

PCT International Search Report dated Apr. 14, 2015 issued for PCT/US14/60267.
Kooiker, et al. TaMYB13-1, a R2R3 MYB transcription factor, regulates teh fructan synthetic pathway and contributes to enhanced fructan accumulation in bread wheat. J Exp Bot Epub Jul. 19, 2013, 64 (12);3681-96.
UniProtKB/Swiss-Prot; Q9SCP1. MYB27 protein (MYB transcription factor) (At3g53200) (Putative transcription factor MYB27) Nov. 28, 2006.

* cited by examiner

*Primary Examiner* — Vinod Kumar

(57) ABSTRACT

Polynucleotides and polypeptides incorporated into expression vectors are introduced into plants and were ectopically expressed. These polypeptides may confer at least one regulatory activity and increased yield, increased light use efficiency, increased photosynthetic capacity, increased photosynthetic rate, increased photosynthetic resource use efficiency, greater vigor, and/or greater biomass as compared to a control plant.

Figure 1:

18 Claims, 222 Drawing Sheets
Specification includes a Sequence Listing.

```
Eucgr.A01648.1          (10)  ---------------------MMGHRGEAREEKLRKGP
clementine0.9_029544m    (8)  MSANGGAPTNQCSTTMDAVILQQTMVYQAAMQEEKLRKGP
AT3G53200.1              (2)  ---------------------------MDFKKEETLRRGP
Glyma10g06680.1          (4)  --------------------------------MQEHLRKGT
Glyma13g20880.1          (6)  --------------------------------MQGENLRKGT
POPTR_0006s12400.1      (12)  -------------------------------MACQGDKLRKGS
GSVIVT01033670001       (14)  --------------------------------MQGENLRKGS
consensus              (842)                                          KGX Eucgr.A01648.1          (10)  WIEQEDEILTAFVTVLGERRWDYIAKTSGLKRSGKSCRLR
clementine0.9_029544m    (8)  WHEEEDELLVTFVTLFGERRWDYIAKASGLKRSGKSCRLR
AT3G53200.1              (2)  WLEEEDERLVKVISLLGERRWDSLAIVSGLKRSGKSCRLR
Glyma10g06680.1          (4)  WLQEEDEQLTSFVTRLGERRWDSLAKVAGLKRSGKSCRLR
Glyma13g20880.1          (6)  WLQEEDEQLTSFVARLGERRWDSLAKVAGLKRSGKSCRLR
POPTR_0006s12400.1      (12)  WQEEEDERLTASATLLGERKWDSIARLSGLMRSGKSCRMR
GSVIVT01033670001       (14)  WLEEEDERLTAFVGLLGERRWDSIARASGLKRSGKSCRLR
consensus              (842)  WXXEEDEXLXXXXXXXGERXWDXXAXXXGLXRSGKSCRXR
```

Fig. 2A

```
Eucgr.A01648.1          (10)  WKNYLCPNLKHGPISPEEERIIIKFHEQWGNK---WSRIA
clementine0.9_029544m    (8)  WLNYLRPNIKHGYISTEEEQIIIQLHKNIKIYLHGWSRIA
AT3G53200.1              (2)  WMNYLNPTLKRGPMSQEEERIIFQLHALWGNK---WSKIA
Glyma10g06680.1          (4)  WMNYLRPNLKHGHFSVEEEQLIVQLQQQLGNK---WAKIA
Glyma13g20880.1          (6)  WMNYLRPNLKHGHFSVEEEQLIVQLQQELGNK---WAKIA
POPTR_0006s12400.1      (12)  WLNYLQPNLKRGHISAEEEQIIIQFHGQWGNK---WARIA
GSVIVT01033670001       (14)  WLNYLRPDLKRCQISABEEQIILQLHKRWGNK---WSWIA
consensus          (842, 843) WXNYL     XXXXSXEEEXXIXXXXXXXXXXXXXWXXIA Eucgr.A01648.1          (10)  EKLPGRTDNEIKNFWKTHLRKKVQSSK-----------
clementine0.9_029544m    (8)  RSLPGRTDNEIKNCWRTRIRKKIQAQE-----------
AT3G53200.1              (2)  RRLPGRTDNEIKNYWRTHYRKKQEAQNYGKLFEWRGNIGE
Glyma10g06680.1          (4)  RKLPGRTDNEIKNFWRTHLRNRAQAQQVPGDFKYKLEIAT
Glyma13g20880.1          (6)  RKLPGRTDNEIKNYWKTHLRKRAQAQQ-----------
POPTR_0006s12400.1      (12)  RRLPGRTDNEIKNYWRTHMRKEIQTEE-EGNFQPKVYSAK
GSVIVT01033670001       (14)  RSLPGRTDNEIKNYWRTHLRKRTEIEE-----------
consensus              (843)  XXLPGRTDNEIKNXWXTXX
```

Fig. 2B

```
Eucgr.A01648.1        (10)  ---------------QALIGAACDDPESQMTTGSSLN--VL
clementine0.9_029544m  (8)  ----------------------------------------Q
AT3G53200.1            (2)  ELLHKYKETEITRTKTTSQEHGFVEVVSMESGKEANGGVG
Glyma10g06680.1        (4)  EEVNQKSIDMDSKDYKHGNVCCQDSEWETKDGSSIH--TL
Glyma13g20880.1        (6)  ----------------------------------------
POPTR_0006s12400.1    (12)  PELLYQNGDSTSAWKYSIRDYNSVDDNIGPAGSSLE--HY
GSVIVT01033670001     (14)  ----------------------------------------

Eucgr.A01648.1        (10)  SFSDFSHLNSPYEIRLLDWMSEFGNDANEVNC-VDCKHWG
clementine0.9_029544m  (8)  ENFQFGRNNAKRDSLFSNLDFNVQKHETDDEHKLGENTFG
AT3G53200.1            (2)  GRESFGVMKSPYENRISDWISEISTDQSEANLSEDHSSNS
Glyma10g06680.1        (4)  PLSDWELGSSPYETRILDWIAELQNGYGDKELEQDCNSTG
Glyma13g20880.1        (6)  ---DWELRSSPYETRILDWIAELQNGYGENELEQDCNSTG
POPTR_0006s12400.1    (12)  ELPSLTHMNSPYETRQYDWIPKLSNDQSQTEVHGEGNGLD
GSVIVT01033670001     (14)  ----------------------------------------
```

Fig. 2C

| | | |
|---|---|---|
| Eucgr.A01648.1 | (10) | LCF---CFPKWDFEEVDNSIWNCPGYLWE-- |
| clementine0.9_029544m | (8) | TDN---SFDVL-----GFPNFAFASSPYEIG |
| AT3G53200.1 | (2) | CSENNINIGTW-WFQETRDFEEFSCSLWS-- |
| Glyma10g06680.1 | (4) | TCNN--YSPQE--FDEGCDSWDYSGSLWDMN |
| Glyma13g20880.1 | (6) | TCN---YYPQE--FDEGCDSWDYSGSLWDMN |
| POPTR_0006s12400.1 | (12) | WCF---CDPAWNSEDSDISTLVSLGSLWDMN |
| GSVIVT01033670001 | (14) | ------------------QGILQFSAS----- |

Fig. 2D

| | | |
|---|---|---|
| GRMZM2G127510_T01 | (32) | MQPHQPPMNGQH--SQPPPQG--------PVVPMPP---- |
| GRMZM2G169615_T01 | (34) | MQPLHQPPMNGQHGPPPPQGSGVPTASQQQAPPPSYYQQQ |
| Bradi1g26210.1 | (28) | MQPPYQPPMNGQHAPPQAPPQS--------SGPPPPPP---- |
| LOC_Os07g33330.1 | (30) | MQQPPPPTMNGGHHAAPPPPQV-------SGAPPPPHGH-- |
| LOC_Os03g37270.1 | (36) | MMQPPP----------PPQWAM--------GPPPPPQ--- |
| GRMZM2G002874_T01 | (38) | MMQPPPPHQ---------QQQWAM------APPPPPQ--- |
| Bradi5g22410.1 | (16) | MMQQPPPS---------QPQPGM-------GAPMPP---- |
| GRMZM2G012628_T01 | (18) | MMQQPPPQ---------QPQPGM-------APPPPP---- |
| GRMZM2G058098_T02 | (20) | MMQQPP-----------QPQPGM-------ALPPPP---- |
| GRMZM2G426591_T01 | (26) | MMPQQQ-----------QPGM--------APPPP------ |
| Bradi3g15180.1 | (22) | MMPQP------------QPGV--------APLPHPQ---- |
| LOC_Os08g09100.1 | (24) | MAPPPP----------PPQAGV-------------------- |
| AT1G11650.2 | (52) | MMQQP------------PPGG---------ILPHH----- |
| Solyc07g064510.2.1 | (48) | MMPQSG-----------VAQPAM-------APMSMDQYQQ |
| Solyc10g005260.2.1 | (68) | MQPA-------------ASSM---------VPPPM----- |
| Solyc02g080420.2.1 | (66) | --MQP------------ANSM---------VPPP------ |
| Solyc03g031720.2.1 | (70) | --MQP------------ANSM---------VPQPMAAPSQ |
| Eucgr.D01310.1 | (56) | MMQPS------------ATGM---------VPPPLDQQQ- |
| POPTR_0004s01690.1 | (54) | MMQQP------------GPGG---------AMLPQQQ-- |
| Glyma07g38940.1 | (58) | MMQA-------------GPGG---------MAQQANQ--- |
| Glyma17g01800.1 | (60) | MMQA-------------GPGG---------MAQQANQQYA |
| Glyma13g27570.1 | (62) | MMQQP------------GPGM---------APP-------- |
| Glyma15g11380.1 | (64) | MMQQP------------GPGM---------APP-------- |

Fig. 6A

| | | |
|---|---|---|
| Eucgr.F03462.1 | (50) | MMQQP----------VPGA--------VPDQQ---- |
| POPTR_0001s45000.1 | (44) | MMQQPG---------IAGA--------GVPQP---- |
| POPTR_0011s14150.1 | (46) | MMQQPG---------VAGV--------GAPQPDQQ- |
| AT4G27000.1 | (40) | MMQQPPPASNG----AATGPGQ--------IPSDQ---- |
| AT5G54900.1 | (42) | MQQPPS---------NAAGAG---------------- |

Fig. 6B

| | | | |
|---|---|---|---|
| GRMZM2G127510_T01 | (32) | -QQQAPPLPYYQQQ------------QAPQYYQQALPQP |
| GRMZM2G169615_T01 | (34) | QQQQQGPPPQYYQQGPPQPWAQQQQYAPPPPQYPPQMQQY |
| Bradi1g26210.1 | (28) | -QQQVPPPQQYYQA------------PPQYYQP----- |
| LOC_Os07g33330.1 | (30) | -YQQQPPPQPYCQQ------------QQPLPPH----Y |
| LOC_Os03g37270.1 | (36) | -YFQAGPPPP---------------PPQYFQG----- |
| GRMZM2G002874_T01 | (38) | -YYQAGHPPP---------------PPPQFYQ----- |
| Bradi5g22410.1 | (16) | -QGAAGQPPQWGTI------------PPPMPHQ----- |
| GRMZM2G012628_T01 | (18) | -QAAGGQPPQWGGI------------PPPMAQQ----- |
| GRMZM2G058098_T02 | (20) | -QTGGGQPPQWGAI------------PPPMTQQ----- |
| GRMZM2G426591_T01 | (26) | -QAAPGAPPHWGGI------------PPPMAPQ--HQY |
| Bradi3g15180.1 | (22) | -QAPTGAPPQWGTI------------PPPMPQQHYAP |
| LOC_Os08g09100.1 | (24) | -AGGGGAPPQWGAI------------PPPVPHQ----- |
| AT1G11650.2 | (52) | -APPPSAQQQYGYQ------------QPYGIAG----- |
| Solyc07g064510.2.1 | (48) | QAPPTQQQQWMMQ------------PPQAQQP----- |
| Solyc10g005260.2.1 | (68) | -AAQPQYQQQWMAQ------------QPQYQ-------- |
| Solyc02g080420.2.1 | (66) | -QYQQ--TQQWMAQ------------PPPQYQV----- |
| Solyc03g031720.2.1 | (70) | QQYQQQPQQHWMAQ------------QQPAAYQ----- |
| Eucgr.D01310.1 | (56) | -QQQQQQQYQYQQQ------------PPQQPPQ----- |
| POPTR_0004s01690.1 | (54) | -PPQQYQQPPYMMM------------MPPPPMAQT----- |
| Glyma07g38940.1 | (58) | -QYAQQQQQPYMMM------------PP---------- |
| Glyma17g01800.1 | (60) | QQQQQQQQAYMMM------------PP---------- |
| Glyma13g27570.1 | (62) | -TMGQQPPQQYQQP------------PPQQQP----Y |
| Glyma15g11380.1 | (64) | -TMGQQPQQQYQQQ------------PPPQQQ---PY |

Fig. 6C

```
Eucgr.F03462.1        (50)  -QYQQQQQQWMMM------------QQAAQPV-----
POPTR_0001s45000.1    (44)  -DQQQQYQQQWMMQ------------QQQQSQP----
POPTR_0011s14150.1    (46)  -QQYQQQQQQWMMQ------------QQQQSQP----
AT4G27000.1           (40)  -QAYLQQQQSWMMQ------------HQQQQQG----
AT5G54900.1           (42)  -QIPSGQQHLWMMM------------QQQQQQQ----
```

Fig. 6D

```
GRMZM2G127510_T01   (32) WGQQQQYAAPPP----QYPPPPQT--Q----HYATPPQQY
GRMZM2G169615_T01   (34) APPPQQYAPPPQQ---QYAAPPQQYAAPPPQYAPPPPQY
Bradi1g26210.1      (28) -------GPPPP----MWGHPQQH----MPPQYAPPPQY
LOC_Os07g33330.1    (30) YQAGPPHAPPPQQPPAMWGQPPPP------PPQYAPPPPQQ
LOC_Os03g37270.1    (36) -------AHPPAA---MWGQPPPP--------QAAPPPAP
GRMZM2G002874_T01   (38) -------AGPPPPA---MWGQPPPQ-------AAAAPAPAG
Bradi5g22410.1      (16) -----YAQPPPQQPQAMWGQPPPQ-----AAYGQPPAPQQ
GRMZM2G012628_T01   (18) -----YGAPPPQQPPAMWGQPPPQ-----AHYGQAPTPQQ
GRMZM2G058098_T02   (20) -----YGAPPPQQPPAMWGQPPSQ-----AHYGQAPPPQP
GRMZM2G426591_T01   (26) APPPTHQAPPPPQ---MWGQAPPPPPPPQAAYGQAPPPPQ
Bradi3g15180.1      (22) PPPQQHHAPPPPQ---MWGQVPPP--QQAAPYGQAPPPPQ
LOC_Os08g09100.1    (24) ---QQQYAPPPPQ---MWGQAPPP--PPQMWGQAPPPPQP
AT1G11650.2         (52) -------AAPPPPQ---MWNPQAAA-----------PPSVQP
Solyc07g064510.2.1  (48) -------QFQP-------SWGQQQQQ--------PSQTMSQQY
Solyc10g005260.2.1  (68) ------VLPPQAGY-YYQPPPQQ--------GGGVPPPQQ
Solyc02g080420.2.1  (66) -------APPQQSG--YYYQQPQQ--Q----GGVPPPQQQ
Solyc03g031720.2.1  (70) -------VPQQSAY-YYQQQQQP--------QYNAAAAAA
Eucgr.D01310.1      (56) ---QPSQQPPPPQPYMMMPPAGHP-------SQAPPPPQM
POPTR_0004s01690.1  (54) -------QPPPPH----MWAQHQAH---------QASIPPPQQ
Glyma07g38940.1     (58) --------QPQPPQ----MWATSAQP--------PSQSVAPPQP
Glyma17g01800.1     (60) --------QPQPPQ----MWAPSAQP--------PSQSVAPPQP
Glyma13g27570.1     (62) VMMPPQAQAPQA----MWAPSAQP-----------PPQQQ
Glyma15g11380.1     (64) VMMPPQHQAPQP----MWAPSAQP-----------PLPQQ
```

Fig. 6E

```
Eucgr.F03462.1       (50)  --------PPPV----GWTPQPVP-----------PPMAA
POPTR_0001s45000.1   (44)  --------VPPPA---GWTPPPVP-----------PPSQY
POPTR_0011s14150.1   (46)  --------VPPPA---GWNPPPVP-----------PPTQY
AT4G27000.1          (40)  --------QPPAG-----WNQQSAP------SSGQPQQQQ
AT5G54900.1          (42)  -QMQLSAAPLGQH---QYGIGSQN----------------
```

Fig. 6F

```
GRMZM2G127510_T01    (32)  ------------------APLPQQQYAPPPQQQYAPSP--
GRMZM2G169615_T01    (34)  -----------------APPPQQYAQPPQYAQPPQYGT
Bradi1g26210.1       (28)  -----------------APPPPHQYGPPPQQYAQPPPQ-
LOC_Os07g33330.1     (30)  -----------------PQLPHQQYAPPPQHYAPPPPQQ
LOC_Os03g37270.1     (36)  ---------------------------------AGG-
GRMZM2G002874_T01    (38)  -----------------------------------G-
Bradi5g22410.1       (16)  ------------------------YYAAP----QAPSAP-
GRMZM2G012628_T01    (18)  ------------------------YYAAPPVPVQAPAAP-
GRMZM2G058098_T02    (20)  ------------------------YYAAPPV----PAAP-
GRMZM2G426591_T01    (26)  AAYGQALPPPQAAYGQAPPPPQAAYYGAVPAPAAVAAAP-
Bradi3g15180.1       (22)  ----------------------HAAYYGAPAAPAQAP----
LOC_Os08g09100.1     (24)  -----------AYGQPPPAQAGYYGAPPQ--AAPAVP-
AT1G11650.2          (52)  ----------------------------------------
Solyc07g064510.2.1   (48)  -------------------------VATNSSPSSN-
Solyc10g005260.2.1   (68)  -------------------------QQQQSQYTASAQP-
Solyc02g080420.2.1   (66)  ---------------------QLQYNASGLAATAGSVQP-
Solyc03g031720.2.1   (70)  --------------------------------------QP-
Eucgr.D01310.1       (56)  ----------------------WAAHQPLPAMPQQAAPG-
POPTR_0004s01690.1   (54)  -------------------------------QQGQGQPP-
Glyma07g38940.1      (58)  ----------------------------------------
Glyma17g01800.1      (60)  ----------------------------------------
Glyma13g27570.1      (62)  --------------------------------------P-
Glyma15g11380.1      (64)  --------------------------------------P-
```

Fig. 6G

```
Eucgr.F03462.1        (50)  ------------------------------QSMAG-
POPTR_0001s45000.1    (44)  ----------------------------GSAAGSA-
POPTR_0011s14150.1    (46)  ----------------------------GAAAGSG-
AT4G27000.1           (40)  --------------------------YGGGGSQNP-
AT5G54900.1           (42)  --------------------------------P-
```

Fig. 6H

| | | |
|---|---|---|
| GRMZM2G127510_T01 | (32) | -YGTT------PGSGEVR‖LWIGDLQHWMDENYLHYNAFA |
| GRMZM2G169615_T01 | (34) | T---------PGSGEVR‖LWIGDLQYWMDENYLHYNAFA |
| Brad1g26210.1 | (28) | QYGAQMAGGPAPGGEDIR‖SLWIGDLQYWMDEAYL-HNAFA |
| LOC_Os07g33330.1 | (30) | QYGAQMAGGPAPGGDEIR‖SLWIGDLQYWMDESYL-SNAFA |
| LOC_Os03g37270.1 | (36) | ----------AAGDEVR‖LWIGDLQFWMEENYL-YNCFS |
| GRMZM2G002874_T01 | (38) | ----------GAGDEAR‖LWIGDLQYWMDENYL-YSCFS |
| Brad15g22410.1 | (16) | ----------AAADEVR‖LWIGDLQYWMDETYI-HGCFA |
| GRMZM2G012628_T01 | (18) | ----------AAADEVR‖LWIGDLQYWMDENYV-FGCFS |
| GRMZM2G058098_T02 | (20) | ----------AAADEVR‖LWIGDLQYWMDDNYV-FGCFS |
| GRMZM2G426591_T01 | (26) | ----------VGPSEVR‖LWIGDLQYWMDDNYI-YGCFA |
| Brad13g15180.1 | (22) | ----------AGPNEVR‖LWIGDLQYWMDENYV-YGCFA |
| LOC_Os08g09100.1 | (24) | ----------AGPNEVR‖LWIGDLQYWMDENYI-SACFA |
| AT1G11650.2 | (52) | ----------TTADEIR‖LWIGDLQYWMDENFL-YGCFA |
| Solyc07g064510.2.1 | (48) | ----------VNPNEVR‖SLWIGDLQYWMDESYL-STCFY |
| Solyc10g005260.2.1 | (68) | ----------TSADEVR‖LWIGDLQFWMDEQYL-YSCFA |
| Solyc02g080420.2.1 | (66) | ----------TSADEIR‖SLWIGDLQFWMDEQYL-LNCFA |
| Solyc03g031720.2.1 | (70) | ----------TSSDEIR‖SLWIGDLQFWMDEQYI-QNCFA |
| Eucgr.D01310.1 | (56) | ----------GGGDEVR‖LWIGDLQYWMDEAYL-GTCFA |
| POPTR_0004s01690.1 | (54) | ----------ATADEVR‖LWIGDLQYWMDENYI-ASCFA |
| Glyma07g38940.1 | (58) | ----------TSADEVR‖LWIGDLQYWMDENYL-YTCLA |
| Glyma17g01800.1 | (60) | ----------TSADEVR‖LWIGDLQYWMDENYL-YTCFA |
| Glyma13g27570.1 | (62) | ----------ASADEVR‖LWIGDLQYWMDENYL-YTCFA |
| Glyma15g11380.1 | (64) | ----------ASADEVR‖LWIGDLQYWMDENYL-YTCFA |

Fig. 61

```
Eucgr.F03462.1        (50)  ----------GAAAEIKSLWIGDLQPHMDETYL-LNCPA
POPTR_0001s45000.1    (44)  ----------AVGDEIKSLWIGDLQQWMDENYI-LSIFS
POPTR_0011s14150.1    (46)  ----------GDGDEIKSLWIGDLQQWMDENYI-LSIFS
AT4G27000.1           (40)  ----------GSAGEIRSLWIGDLQPWMDENYI-MNVFG
AT5G54900.1           (42)  ----------GSASDVKSLWIGDLQQWMDENYI-MSVFA
consensus            (844)             XLWIGDLQXXMXXXXXXXXXX
```

Fig. 6J

| | | |
|---|---|---|
| GRMZM2G127510_T01 | (32) | AVA-QQIASVKIIRNKQTGHSEGYGFIEFYSRAAAEHTLM |
| GRMZM2G169615_T01 | (34) | PVA-QQIASVKIIRNKQTGHSEGYGFIEFYSQAAAEHTLM |
| Bradi1g26210.1 | (28) | PMGPQQVASVKIIRNKQTGQPEGYGFIEFHSRAAAEYALA |
| LOC_Os07g33330.1 | (30) | PMG-QQVTSVKVIRNKQSGHSEGYGFIEFQSHAAAEYALA |
| LOC_Os03g37270.1 | (36) | QAG--ELISAKIIRNKQTGQPEGYGFIEFGSHAIAEQVLQ |
| GRMZM2G002874_T01 | (38) | QAG--EVISVKIIRNKQTGQPEGYGFIEFSNHAVAEQVLQ |
| Bradi5g22410.1 | (16) | STG--ELQSVKLIRDKQTGQLQGYGFVEFTSHAAAERVLQ |
| GRMZM2G012628_T01 | (18) | NTG--EVQNVKLIRDKNSGQLQGYGFVEFTSRAAAERVLQ |
| GRMZM2G058098_T02 | (20) | NTG--EVQNVKLIRDKNSGQLQGYGFVEFTSRAAAERVLQ |
| GRMZM2G426591_T01 | (26) | STG--EVQNVKLIRDKHTGQLQGYGFIEFISRAAAERVLQ |
| Bradi3g15180.1 | (22) | HTG--EVQSVKLIRDKQTGQLQGYGFVEFTTRAGAERVLQ |
| LOC_Os08g09100.1 | (24) | PTG--ELQSVKLIRDKQTGQLQGYGFIEFTSHAGAERVLQ |
| AT1G11650.2 | (52) | HTG--EMVSAKVIRNKQTGQVEGYGFIEFASHAAAERVLQ |
| Solyc07g064510.2.1 | (48) | HTG--ELVSAKVIRNKQSGQSEGYGFLEFRSHAAAETVLQ |
| Solyc10g005260.2.1 | (68) | QTG--EVVSAKVIRNKQTQQSEGYGFIEFNSHAAAERNLQ |
| Solyc02g080420.2.1 | (66) | QTG--EVTSAKVIRNKQSGQSEGYGFIEFISHAAAERNLQ |
| Solyc03g031720.2.1 | (70) | HTG--EVASVKVIRNKQSGQSEGYGFVEFISHAAAERNLQ |
| Eucgr.D01310.1 | (56) | ATG--EVANVKVIRNKQTMPEGYGFIEFYTRAAAERVLQ |
| POPTR_0004s01690.1 | (54) | HTG--EVASVKIIRNKQTSQIEGYGFIEMTSHGAAERILQ |
| Glyma07g38940.1 | (58) | HTG--EVASVKVIRNKQTSQSEGYGFIEFTSRAGAERVLQ |
| Glyma17g01800.1 | (60) | HTG--ELASVKVIRNKQTSQSEGYGFIEFTSRAGAERVLQ |
| Glyma13g27570.1 | (62) | HTG--EVTSVKVIRNKQTSQSEGYGFIEFNSRAGAERILQ |
| Glyma15g11380.1 | (64) | HTG--EVSSVKVIRNKQTSQSEGYGFIEFNSRAGAERILQ |

Fig. 6K

```
Eucgr.F03462.1        (50)  HSG--EVLSAKVIRNKQTALPEGYGFIEFMTRAAAERILQ
POPTR_0001s45000.1    (44)  TTG--EVVQAKVIRNKQTGYPEGYGFIEFVSHAAAERILQ
POPTR_0011s14150.1    (46)  ATG--EIVQAKVIRNKQTGYPEGYGFIEFVSRAAAERILQ
AT4G27000.1           (40)  LTG--EATAAKVIRNKQNGYSEGYGFIEFVNHATAERNLQ
AT5G54900.1           (42)  QSG--EATSAKVIRNKLTGQSEGYGFIEFVSHSVAERVLQ
consensus            (844)  XXXXXXXXXKXIRXXXXXXXGYGFXEXXXXXXAEXXLX
```

Fig. 6L

| | | |
|---|---|---|
| GRMZM2G127510_T01 | (32) | NFNGQMMPNV-EMTFKLNWASAS TGDK-R-GDSGS DRTIF |
| GRMZM2G169615_T01 | (34) | NFNGQMMPNI-EMAPKLNWASAS TGDK-R-GDNGS DHAIF |
| Bradi1g26210.1 | (28) | SFNGHAMPNV-DLPFKLNWASAS AGDR-R-GDDGS DHTIF |
| LOC_Os07g33330.1 | (30) | NFNGRMMLNV-DQLFKLNWASSC AGER-RAADDGP EHTIF |
| LOC_Os03g37270.1 | (36) | GYNGQMMPNG-NQVFKLNWATSC AGEK-R-GDDGS DYTIF |
| GRMZM2G002874_T01 | (38) | NYNGQMMPNV-NQPFKLNWATSG AGEK-R-GDDGS DYTIF |
| Bradi5g22410.1 | (16) | GYNGHAMPNV-DLAYRLNWA--S AGEK---RDDTP DYTIF |
| GRMZM2G012628_T01 | (18) | TYNGQMMPNV-DLTFRLNWA--S AGEK---RDDTP EYTIF |
| GRMZM2G058098_T02 | (20) | TYNGQMMPNV-DLTFRLNWA--S AGEK---RDDTP DYTIF |
| GRMZM2G426591_T01 | (26) | TYNGTMMPNV-ELPFRLNWA--S AGEK---RDDTP DYTIF |
| Bradi3g15180.1 | (22) | TYNGAIMPNV-EMPYRLNWA--S AGEK---RDDGP DYTIF |
| LOC_Os08g09100.1 | (24) | TYNGAMMPNV-EQTYRLNWA--S AGEK---RDDTP DYTIF |
| AT1G11650.2 | (52) | TFNNAPIPSFPDQLFRLNWASLS SGDK---RDDSP DYTIF |
| Solyc07g064510.2.1 | (48) | TYNGALMPNV-EQNFRMNWASLG AGER---RDDSP EYTIF |
| Solyc10g005260.2.1 | (68) | AYNGTLMPNI-EQNFRLNWASLG SGEK-R-SDNTP EYTIF |
| Solyc02g080420.2.1 | (66) | AYNGTLMPNI-EQNFRLNWASLG SGEK-R-SDNGP EYTIF |
| Solyc03g031720.2.1 | (70) | TYNGSMMPNS-EQPFRLNWASLG SGEK-R-SDNGP EYTIF |
| Eucgr.D01310.1 | (56) | TYNGAIMPNG-GQSFRLNWA--S AGEK-R-ADDTP DYTIF |
| POPTR_0004s01690.1 | (54) | TYNGTPMPNG-EQNFRLNWASFS GGDK---RDDSP DFTIF |
| Glyma07g38940.1 | (58) | TYNGTIMPNG-GQNFRLNWATLS AGER-R-HDDSP DHTIF |
| Glyma17g01800.1 | (60) | TYNGTIMPNG-GQNFRLNWATFS AGER-R-HDDSP DHTIF |
| Glyma13g27570.1 | (62) | TYNGAIMPNG-GQSFRLNWATFS AGERSR-HDDSP DYTIF |
| Glyma15g11380.1 | (64) | TYNGAIMPNG-GQSFRLNWATFS AGERSR-QDDSP DYTIF |

Fig. 6M

```
Eucgr.F03462.1          (50)  TYNGTLMPNS-DQNFRLNWATLGPGER-R-QDEGPDYTIF
POPTR_0001s45000.1      (44)  TYNGTPMPNS-EQTFRLNWATLGAGER-R-QDDGPDYTVF
POPTR_0011s14150.1      (46)  TYNGTPMPNS-EQAFRLNWATLGAGER-R-QDDGPDFTVF
AT4G27000.1             (40)  TYNGAPMPSS-EQAFRLNWAQLGAGER-R-QAEGPEHTVF
AT5G54900.1             (42)  TYNGAPMPST-EQTFRLNWAQAGAGEK-RFQTEGPDHTIF
consensus           (844, 845) XXNXXXXXXXXXXXXXXNWAXXX          XXXXF
```

Fig. 6N

| Identifier | SEQ ID | Sequence |
|---|---|---|
| GRMZM2G127510_T01 | (32) | VGDLAHDVTDSMLEDVFRAKYPSVRGANVVDRMTGWPKG |
| GRMZM2G169615_T01 | (34) | VGDLAPDVTDSMLEDVFRANYPSVRGAKVVVDRITGRPKG |
| Bradi1g26210.1 | (28) | VGDLASDVTDSMLQEIFKASYPSVRGANVVTDRATGRSKG |
| LOC_Os07g33330.1 | (30) | VGDLASDVTDSMLEEAFKTSYPSVRGAKVVFDKVTGRSKG |
| LOC_Os03g37270.1 | (36) | VGDLASDVTDLILQDTFKAHYQSVKGAKVVFDRSTGRSKG |
| GRMZM2G002874_T01 | (38) | VGDLASDVTDFILQDTFKSRYPSVKGAKVVFDRTTGRSKG |
| Bradi5g22410.1 | (16) | VGDLAADVTDYILQETFRVHYPSVKGAKVVTDKMTMRSKG |
| GRMZM2G012628_T01 | (18) | VGDLAADVTDYLLQETFRVHYPSVKGAKVVTDKLTMRTKG |
| GRMZM2G058098_T02 | (20) | VGDLAADVTDYLLQETFRVHYPSVKGAKVVTDKLTMRTKG |
| GRMZM2G426591_T01 | (26) | VGDLAADVTDYVLQETFRAHYPSVKGAKVVTDKLTMRTKG |
| Bradi3g15180.1 | (22) | VGDLAADVTDYILQETFRVHYPSVKGAKVVTDKLTMRSKG |
| LOC_Os08g09100.1 | (24) | VGDLAADVTDYILQETFRVHYPSVKGAKVVTDKMTMRSKG |
| AT1G11650.2 | (52) | VGDLAADVTDYILLETFRASYPSVKGAKVVIDRVTGRTKG |
| Solyc07g064510.2.1 | (48) | VGDLAADVTDYVLQETFKPVYSSVKGAKVVTDRITGRTKG |
| Solyc10g005260.2.1 | (68) | VGDLAADVTDYMLQETFRPNYPSIKGAKVVTDRATGHTKG |
| Solyc02g080420.2.1 | (66) | VGDLAADVSDYMLQETFRANYPSVKGAKVVTDKATGRTKG |
| Solyc03g031720.2.1 | (70) | VGDLAADVTDYMLQETFRANYPSVKGAKVVTDRVTGRTKG |
| Eucgr.D01310.1 | (56) | VGDLASDVTDYMLQEMFRGRYPSVRSAKVVMDRLTSRTKG |
| POPTR_0004s01690.1 | (54) | VGDLAADVTDFMLQETFRAHFPSVKGAKVVIDRLTGRTKG |
| Glyma07g38940.1 | (58) | VGDLAADVTDYLLQETFRARYPSIKGAKVVIDRLTGRTKG |
| Glyma17g01800.1 | (60) | VGDLAADVTDYLLQETFRARYPSAKGAKVVIDRLTGRTKG |
| Glyma13g27570.1 | (62) | VGDLAADVTDYLLQETFRARYNSVKGAKVVIDRLTGRTKG |
| Glyma15g11380.1 | (64) | VGDLAADVTDYLLQETFRARYNSVKGAKVVIDRLTGRTKG |

Fig. 60

| | | |
|---|---|---|
| Eucgr.F03462.1 | (50) | VGDLAADVTDHMLQETFRAHYPSVKGAKIVIDRTTGRSKG |
| POPTR_0001s45000.1 | (44) | IGDLAADVNDYLLQETFRNVYSSVKGAKVVTDRVTGRSKG |
| POPTR_0011s14150.1 | (46) | VGDLAADVNDYLLQETFRNVYPSVKGAKVVTDRVTGRSKG |
| AT4G27000.1 | (40) | VGDLAPDVTDHMLTETFKAVYSSVKGAKVVNDRTTGRSKG |
| AT5G54900.1 | (42) | VGDLAPEVTDYMLSDTFKNVYGSVKGAKVVLDRTTGRSKG |
| consensus | (845) | XGDLAXXVXDXXLXXXFXXXXXSXXXAXXVXDXXTXXXKG |

Fig. 6P

| | | |
|---|---|---|
| GRMZM2G127510_T01 | (32) | FGFVRFGDLNEQARAMTEMNGMLLSTRQMRIGAAANKKNR |
| GRMZM2G169615_T01 | (34) | YGFVHFGDLNEQARAMTEMNGMMLSTRKMRIGAAASKKNT |
| Bradi1g26210.1 | (28) | YGFVRFGDVNEQTRAMTEMNGVTLSSRQLRIGPAANKKNM |
| LOC_Os07g33330.1 | (30) | YGFVRFGDENEQTRAMTEMNGATLSTRQMRLGPAANKKNM |
| LOC_Os03g37270.1 | (36) | YGFVKFGDLDEQTRAMTEMNGQYCSSRPMRIGPASNKKNI |
| GRMZM2G002874_T01 | (38) | YGFVKFADSDEQTRAMTEMNGQYCSSRAMRLGPASNKKNT |
| Bradi5g22410.1 | (16) | YGFVKFGDPTEQARAMTEMNGMPCSSRPMRIGPAANRKTT |
| GRMZM2G012628_T01 | (18) | YGFVKFGDPTEQARAMTEMNGMPCSSRPMRIGPAASRKNT |
| GRMZM2G058098_T02 | (20) | YGFVKFGDPTEQARAMTEMNGMPCSSRPMRIGPAASRKNA |
| GRMZM2G426591_T01 | (26) | YGFVKFGDPNEQARAMTEMNGMLCSSRPMRIGPAANKKAT |
| Bradi3g15180.1 | (22) | YGFVKFSDPTEQTRAMTEMNGMVCSSRPMRIGPAANKQKV |
| LOC_Os08g09100.1 | (24) | YGFVKFGDPSEQARAMTEMNGMVCSSRPMRIGPAANKKAT |
| AT1G11650.2 | (52) | YGFVRFSDESEQIRAMTEMNGVPCSTRPMRIGPAASKKGV |
| Solyc07g064510.2.1 | (48) | YGFVKFSDESEQLRAMTEMNGVLCSSRPMRIGPAANKKPM |
| Solyc10g005260.2.1 | (68) | YGFVRFGDESEQLRAMTEMNGKFCSTRPMRIGPAANKKNS |
| Solyc02g080420.2.1 | (66) | YGFVKFGDESEQLRAMTEMNGQFCSTRPMRIGPAANKKSM |
| Solyc03g031720.2.1 | (70) | YGFVKFADESEQLHAMTEMNGKFCSTRPMRIGPAANKKSV |
| Eucgr.D01310.1 | (56) | YGFVKFGDESEQIRAMSEMNGVFLSTRPMRIGLATNKKIA |
| POPTR_0004s01690.1 | (54) | YGFVRFGDESEQLRAMTEMNGAFCSTRPMRVGLASNKKAV |
| Glyma07g38940.1 | (58) | YGFVRFGDESEQVRAMTEMQGVLCSTRPMRIGPASNKNPS |
| Glyma17g01800.1 | (60) | YGFVRFGDESEQVRAMSEMQGVLCSTRPMRIGPASNKNPS |
| Glyma13g27570.1 | (62) | YGFVRFSDESEQVRAMTEMQGVLCSTRPMRIGPASNKTPT |
| Glyma15g11380.1 | (64) | YGFVRFSEESEQMRAMTEMQGVLCSTRPMRIGPASNKTPA |

Fig. 6Q

| | | |
|---|---|---|
| Eucgr.F03462.1 | (50) | YGFVRFGDETEQLRAMTEMNGMYCSSRPMRIGPAANKKPI |
| POPTR_0001s45000.1 | (44) | YGFVRFADENEQMRAMVEMNGQYCSTRPMRIGPAATKKPL |
| POPTR_0011s14150.1 | (46) | YGFIRFADENEQRRAMVEMNGQYCSTRPMRIGPAATKKPL |
| AT4G27000.1 | (40) | YGFVRFADESEQIRAMTEMNGQYCSSRPMRTGPAANKKPL |
| AT5G54900.1 | (42) | YGFVRFADENEQMRAMTEMNGQYCSTRPMRIGPAANKNAL |
| consensus | (845) | XGFXXFXXXXEQXXAMXEMXGXXXSXRXXRXGXAX |

Fig. 6R

| | | |
|---|---|---|
| GRMZM2G127510_T01 | (32) | DAQQTYATDGAY--QS--SKG-NSSENDPNNTTVFVGGLD |
| GRMZM2G169615_T01 | (34) | DAQQTYATNGAY--QS--SQG-NCSENDPNNTTVFVGGLD |
| Bradi1g26210.1 | (28) | GTQQTYSTNG-YQSQS--SQG-NDVQNDPNNTTIFVGGLD |
| LOC_Os07g33330.1 | (30) | GTQQTYSTNG-Y--QS--SQG-NSLENDPNNTTIFVGGLD |
| LOC_Os03g37270.1 | (36) | GGQQQPSAI--Y--QN--TQG-TDSDSDPNNTTVFVGGLD |
| GRMZM2G002874_T01 | (38) | GGPQPSSAI--Y--QN--TQG-TDSDSDPNNTTVFVGGLD |
| Bradi5g22410.1 | (16) | G--VQERVP--N--TN--TQG-AQSDNDPNNTTIFVGGLD |
| GRMZM2G012628_T01 | (18) | GGVVQERVP------N--SQG-AQSENDPNNTTIFVGGLD |
| GRMZM2G058098_T02 | (20) | GGVVQERVP------N--SQG-AQSENDPNNTTIFVGGLD |
| GRMZM2G426591_T01 | (26) | V--VQEKVP------S--AQG-VQSDNDPNNTTIFVGGLD |
| Bradi3g15180.1 | (22) | SGAQEKVPS---------AQG-VQSDSDPSNTTIFVGGLD |
| LOC_Os08g09100.1 | (24) | G--VQEKVP------S--AQG-VQSDSDPSNTTIFVGGLD |
| AT1G11650.2 | (52) | TGQRDSYQS------S--AAG-VTTDNDPNNTVFVGGLD |
| Solyc07g064510.2.1 | (48) | G--TPQKAT--Y--QN--PQA-TQGESDPNNTTIFVGGLD |
| Solyc10g005260.2.1 | (68) | GGQM--QAS--Y--QS--T-G-TQNEDDPTNTTIFVGNLD |
| Solyc02g080420.2.1 | (66) | GGQS--QAS--Y--QS--SPG-TQNEDDPSNTTIFVGNLD |
| Solyc03g031720.2.1 | (70) | PGQV--QAS--Y--QS--TNG-TQNEDDPSNTTIFVGNLD |
| Eucgr.D01310.1 | (56) | TGQQYQKAS--Y--QN--TQV-TPNETDPNNKTVFVGGLD |
| POPTR_0004s01690.1 | (54) | VGQQYPKAS--Y--QN--PQ--PQNDGDPNNTTIFVGNLD |
| Glyma07g38940.1 | (58) | T-QSQPKAS--Y--QN--PQG-AQNEHDPNNTTIFVGNLD |
| Glyma17g01800.1 | (60) | T-QSQPKAS--Y--QN--PQG-AQNEHDPNNTTIFVGNLD |
| Glyma13g27570.1 | (62) | T-QSQPKAS--Y--QNSPQG-SQNENDPNNTTIFVGNLD |
| Glyma15g11380.1 | (64) | T-QSQPKAS--Y--LNSQPQG-SQNENDPNNTTIFVGNLD |

Fig. 6S

```
Eucgr.F03462.1      (50)  ATQQYQSAS--Y--QN--SQG-NQGENDPNN TTIFVGGLD
POPTR_0001s45000.1  (44)  T-QQYQKAA--Y--QS--PQG-NQGESDPNN TTIFVGALD
POPTR_0011s14150.1  (46)  T-QQYQKAT--Y--QN--PQG-NQGENDPNN TTIFVGALD
AT4G27000.1         (40)  T---MQPAS--Y--QN--TQG-NSGESDPTN TTIFVGAVD
AT5G54900.1         (42)  ---PMQPAM--Y--QN--TQGANAGDNDPNN TTIFVGGLD
consensus          (846)                                   XTXFVGXXD
```

Fig. 6T

| | | |
|---|---|---|
| GRMZM2G127510_T01 | (32) | SNVNEEYLRQIFTPYGEISYVKIPVGKHCGFVQFTSRSCA |
| GRMZM2G169615_T01 | (34) | SNVDEEYLRQIFTPYGEISYVKIPVGKHCGFVQFTSRSCA |
| Bradi1g26210.1 | (28) | SNIDENYLRQVFTPYGEVGYVKIPVGKRCGFVQFTSRSCA |
| LOC_Os07g33330.1 | (30) | SNVNEDHLKQVFTPYGEIGYVKIPLGKRCGFVQFTSRSSA |
| LOC_Os03g37270.1 | (36) | PSVTDEVLKQAFSPYGELVYVKIPVGKRCGFVQYSNRASA |
| GRMZM2G002874_T01 | (38) | PSVTDELLKQTFSPYGELLYVKIPVGKRCGFVQYSNRASA |
| Bradi5g22410.1 | (16) | PNVTEDALKQVFAPYGEVIHVKIPVGKRCGFVQFVNRPSA |
| GRMZM2G012628_T01 | (18) | PNVTEDTLKQVFSPYGEVVHVKIPVGKRCGFVQFVTRPSA |
| GRMZM2G058098_T02 | (20) | PNVTEDVLKQAFSPYGEVIHVKIPVGKRCGFVQFVTRPSA |
| GRMZM2G426591_T01 | (26) | PNVTEDMLKQVFTPYGDVVHVKIPVGKRCGFVQYANRSSA |
| Bradi3g15180.1 | (22) | PNVTEDMLKQVFAPYGEVVHVKIPVGKRCGFVQYASRSSS |
| LOC_Os08g09100.1 | (24) | PSVTDDMLKQVFTPYGDVVHVKIPVGKRCGFVQFANRASA |
| AT1G11650.2 | (52) | ASVTDDHLKNVFSQYGEIVHVKIPAGKRCGFVQFSEKSCA |
| Solyc07g064510.2.1 | (48) | PSVAEEHLRQVFSPYGELVHVKIVAGKRCGFVQFGSRASA |
| Solyc10g005260.2.1 | (68) | ASVTDDHLRQVFGNYGQLLHVKIPLGKRCGFVQFTDRSCA |
| Solyc02g080420.2.1 | (66) | SNITDEHLRQIFGHYGQLLHVKIPVGKRCGFIQFADRSCA |
| Solyc03g031720.2.1 | (70) | ANVTDDHLRQVFGNYGQLLHVKIPVGKRCGFVQFADRSCA |
| Eucgr.D01310.1 | (56) | PNVTDDHLRQVFGQYGEIVQVKIPPGKRCGFVQFADRSCA |
| POPTR_0004s01690.1 | (54) | SNVMDDHLKELFGQYGQLLHVKIPAGKRCGFVQFADRSSA |
| Glyma07g38940.1 | (58) | PNVTDDHLRQVFGHYGELVHVKIPAGKRCGFVQFADRSCA |
| Glyma17g01800.1 | (60) | PNVTDDHLRQVFGQYGELVHVKIPAGKRCGFVQFADRSCA |
| Glyma13g27570.1 | (62) | PNVTDDHLRQVFSQYGELVHVKIPAGKRCGFVQFADRSCA |
| Glyma15g11380.1 | (64) | PNVTDDHLRQVFSQYGELVHVKIPAGKRCGFVQFADRSCA |

Fig. 6U

```
Eucgr.F03462.1        (50)  PSVSDDLLRQVFSQYGELHHVKIPPGKRCGFVQFTSRACA
POPTR_0001s45000.1    (44)  PSVTDDTLRAVFSKYGELVHVKIPAGKRCGFVQFANRTCA
POPTR_0011s14150.1    (46)  PSVTDDTLRAVFSKYGELVHVKIPAGKRCGFVQFANRTSA
AT4G27000.1           (40)  QSVTEDDLKSVFGQFGELVHVKIPAGKRCGFVQYANRACA
AT5G54900.1           (42)  ANVTDDELKSIFGQFGELLHVKIPPGKRCGFVQYANKASA
consensus            (846)  XXXXXXXLXXXFXXXGXXXXVKIXXGKXCGFXQXXXXXXX
```

Fig. 6V

| | | |
|---|---|---|
| GRMZM2G127510_T01 | (32) | EEAIRMLNGSQVGGQKVRLSWGRSPQNRQ-ASQHDANNQY |
| GRMZM2G169615_T01 | (34) | EEAIQMLNGSQIGGQKARLSWGRTQNRQ-ASQHDANSQY |
| Bradi1g26210.1 | (28) | EEAINALNGTPIGGNNVRLSWGRSTQNKQ-APQQDAN-QG |
| LOC_Os07g33330.1 | (30) | EEAIRVLNGSQIGGQQVRLSWGRTPQNKQ-APQQDAN-QW |
| LOC_Os03g37270.1 | (36) | EEAIRMLNGSQLGGQSIRLSWGRSPGNK--QPQQDQN-QW |
| GRMZM2G002874_T01 | (38) | EEAIRVLNGSQLGGQSIRLSWGRSPANK--QPQQEQS-QW |
| Bradi5g22410.1 | (16) | EQALQMLQGTPIGGQNVRLSWGRSPSNKQAQPQQESS-QW |
| GRMZM2G012628_T01 | (18) | EQALLMLQGALIGAQNVRLSWGRSLSNKQAQPQQESN-QW |
| GRMZM2G058098_T02 | (20) | EQALLMLQGALIGAQNVRLSWGRSLSNKQTQPQQESM-QW |
| GRMZM2G426591_T01 | (26) | EEALVILQGTLVGGQNVRLSWGRSPSNK---QVQDSN-QW |
| Bradi3g15180.1 | (22) | EEALLMLQGTVIGGQNVRLSWGRSPSNKQVQTPQDSN-QW |
| LOC_Os08g09100.1 | (24) | DEALVLLQGTLIGGQNVRLSWGRSPSNRQAQPQQDSN-QW |
| AT1G11650.2 | (52) | EEALRMLNGVQLGGTTVRLSWGRSPSNK---QSGDPS-QF |
| Solyc07g064510.2.1 | (48) | EQALSSLNGTQLGGQSIRLSWGRSPSNK----QSDQA-QW |
| Solyc10g005260.2.1 | (68) | EEALNALSGTQLGGQTIRLSWGRSPSNKQ-QSQGDPN-QW |
| Solyc02g080420.2.1 | (66) | EEALRVLNGTQLGGQSIRLSWGRSPANKQ-QPQLDPN-QY |
| Solyc03g031720.2.1 | (70) | EEALRALSGTQLGGQTIRLSWGRSPSNKQ-QPQADPN-QY |
| Eucgr.D01310.1 | (56) | EEALRMLNGTQLGGQNIRLSWGRSPANK--QPQSDPS-QY |
| POPTR_0004s01690.1 | (54) | EEALKMLNGAQLSGQNIRLSWGRNPSNK--QAQPDAN-QY |
| Glyma07g38940.1 | (58) | EEALRVLNGTLLGGQNVRLSWGRSPSNK--QAQPDAN-QW |
| Glyma17g01800.1 | (60) | EEALRVLNGTLLGGQNVRLSWGRSPSNK--QAQPDAN-QW |
| Glyma13g27570.1 | (62) | EEALRVLNGTLLGGQNVRLSWGRSPSNK--QAQADPN-QW |
| Glyma15g11380.1 | (64) | EEALRVLNGTLLGGQNVRLSWGRSPSNK--QAQADPN-QW |

Fig. 6W

```
Eucgr.F03462.1        (50)  EQALLMLNGTQLGGQSIRLSWGRSPSNK--QAQPEQA-QW
POPTR_0001s45000.1    (44)  EQALSMLNGTQIAGQNIRLSWGRSPSNK--QAQPDQS-QW
POPTR_0011s14150.1    (46)  EQALSMLNGTQIAGQNIRLSWGRSPSNK--QVQPDQS-QW
AT4G27000.1           (40)  EQALSVLNGTQLGGQSIRLSWGRSPSNK--QTQPDQA-QY
AT5G54900.1           (42)  EHALSVLNGTQLGGQSIRLSWGRSP-----NKQSDQA-QW
consensus            (846)  XXAXXXLXGXXXXXXXXRLSWGRX
```

Fig. 6X

| | | |
|---|---|---|
| GRMZM2G127510_T01 | (32) | N------GNSYYGYQQPGYE-----GY--GY------GA |
| GRMZM2G169615_T01 | (34) | N------GNNYYRYQQPGNE-----GY--SY------GA |
| Bradi1g26210.1 | (28) | N------GSNYYGY-QQGND-----AY---Y------GA |
| LOC_Os07g33330.1 | (30) | -------NGNYYGY-QQGYD-----SSY---Y------GA |
| LOC_Os03g37270.1 | (36) | -------NAGYYGYPPQGYD-----PY--GY-------V |
| GRMZM2G002874_T01 | (38) | S------GGGYYGY-PQGYD-----PY--GY-------A |
| Bradi5g22410.1 | (16) | GA--NA-GAGYYGGYGQGYD-----AYG-GY-------- |
| GRMZM2G012628_T01 | (18) | GAA--AG-AGGYYGGYGQGYE-----AYGSGY-------- |
| GRMZM2G058098_T02 | (20) | GAGAPAG-VGDYYGGYGQGYE-----AYGSGY-------- |
| GRMZM2G426591_T01 | (26) | AG----A-NAGYYGY-GQGYE-----AY--GY-------- |
| Bradi3g15180.1 | (22) | GGA--TA-NAGYYGY-GQGYE-----AY--GY-------A |
| LOC_Os08g09100.1 | (24) | GG----A-NAGYYGY-GQGYE-----GY--GY-------- |
| AT1G11650.2 | (52) | -----------YYGGYGQGQE-----QY--GY-------- |
| Solyc07g064510.2.1 | (48) | GGSAGAG-AGAYYGY-AQGYE-----AY--GY-------A |
| Solyc10g005260.2.1 | (68) | --------SGGYYGY-TPGYD-----AY--GY-------A |
| Solyc02g080420.2.1 | (66) | ----------AGYYGY-TAGYE-----GY--GY-------A |
| Solyc03g031720.2.1 | (70) | ---------GGYYGY-SAGYDAAAAAY--GY-------A |
| Eucgr.D01310.1 | (56) | ---------GGYYGY-AAGYE-----NY--GY-------G |
| POPTR_0004s01690.1 | (54) | ---------GGGYYGYGQQGYE-----NY--GY-------A |
| Glyma07g38940.1 | (58) | NG----S-GGGYYGYAQGGYE-----NY--GY-------A |
| Glyma17g01800.1 | (60) | NG---SG-GGGYYGYAQGGYE-----NY--GY-------A |
| Glyma13g27570.1 | (62) | NG-GAGS-GGGYYGYAQGGYE-----NY--GY-------A |
| Glyma15g11380.1 | (64) | NGAAGAGSGGGYYGYAQGGYE-----NY--GY-------A |

Fig. 6Y

```
Eucgr.F03462.1        (50) N-------GGGYYGY-PQGYE-----AY--GY-------A
POPTR_0001s45000.1    (44) N-------GGGYYGY-PQGYD-----AY--GYAAAAAAAA
POPTR_0011s14150.1    (46) N-------GGGYYGY-PQGYD-----AY--GY------AA
AT4G27000.1           (40) GG------GGGYYGYPPQGYE-----AY--GY-------A
AT5G54900.1           (42) N-------GGGYYGYPPQPQG-----GY--GY-----AAQ
```

Fig. 6Z

```
GRMZM2G127510_T01      (32) S-SAQDPSMQNY--YGYS--GC-GNYEQQQPTQEQQLQQP
GRMZM2G169615_T01      (34) P-NAQDPSIQNY--YGYP--GY-GNYEQQSTQEQQQQPP
Brad1g26210.1          (28) P-NAQDPSMQNY---GYS--GY-GNYEQQQPAQQQPPPS
LOC_Os07g33330.1       (30) P-NAQDPSAQNY--YGYS--GY-GNYEQQQ---EPPQQQQ
LOC_Os03g37270.1       (36) R-PPQDPAMYAY--AAYP--GY-GNY--------QQPAPQQ
GRMZM2G002874_T01      (38) R-PPQDPAMYAY--AAYP--GY-GNYQ-------QQPPQQP
Brad15g22410.1         (16) A-QPQDPNMYGY--GAYA--GY-PNYQQQAVAQQPPQQQV
GRMZM2G012628_T01      (18) A-QPQDPNMYGY--GAYG--GY-PNYQ-------QQPAAQQ
GRMZM2G058098_T02      (20) A-QPQDPNMYGY--GAYV--GY-PNYQ-------QQPAAQQ
GRMZM2G426591_T01      (26) P-QSQDPNMYNYGAGAYA--GY-PNYQ-------QQPVAQQ
Brad13g15180.1         (22) A-QPQDPNMYGY--GAYA--GY-PNYP-------QQQAAQQ
LOC_Os08g09100.1       (24) A-QPQDPNMYGY--GAYA--GY-PNY--------QQPLAQQ
AT1G11650.2            (52) T-MPQDPNAY-Y--GGYSGGGYSGGYQQTPQAGQQPPQQP
Solyc07g064510.2.1     (48) P-PAQDPNMY-Y--GNYP--GY-GNY--------QQPQQ--
Solyc10g005260.2.1     (68) Q-PTQDPNMY-Y--AGYA--GY-GNYA-------QPPHQQQ
Solyc02g080420.2.1     (66) P-PAQDPNQY-Y--AGYA--GY-GNY--------AQPQQQQ
Solyc03g031720.2.1     (70) Q-PAQDPNLY-Y--GGYA--GY-GNY--------PPQQQQ
Eucgr.D01310.1         (56) A-ASQDANMY-Y--GGYA--GY-ANY--------QQPQQQQ
POPTR_0004s01690.1     (54) P-ATQDPNMY-Y--GGYP--GY-GNY--------QQGQQQ
Glyma07g38940.1        (58) P-AGQDPNM--Y--GSYP--GY-ANY--------QPPQQQ
Glyma17g01800.1        (60) P-AGQDPNM--Y--GSYP--GY-ANY--------QPPQQPQ
Glyma13g27570.1        (62) PAAGQDPNM--Y--GSYP--GY-PGY--------QPPQQQQ
Glyma15g11380.1        (64) P-AGQDPNM--Y--GSYP--GY-PGY--------QAPQQQQ
```

Fig. 6AA

```
Eucgr.F03462.1          (50)  P-PTQDPNMF-Y--GGYA--GY--NY-------QQPVTYQ
POPTR_0001s45000.1      (44)  A-APQDPSMY-Y--GGYP--GY-GNYQQPGAYQQPGAYQ
POPTR_0011s14150.1      (46)  A-APQDPNMY-Y--GGYP--GY-GNY-------QQPGAYQ
AT4G27000.1             (40)  P-PPQDPNAY-Y--GGYAGGGY-GNY-------QQPGGYQ
AT5G54900.1             (42)  P-PTQDPNAY-Y--GGYT--GY-GNY-------QQQRQ--
```

Fig. 6AB

```
GRMZM2G127510_T01    (32) PPPQH----------------------------------
GRMZM2G169615_T01    (34) PAQEQPPPAPQ---------------------------
Bradi1g26210.1       (28) QQQQQPPQQ-----------------------------
LOC_Os07g33330.1     (30) QPPQQPPQQPQDNKFSTSPITR----------------
LOC_Os03g37270.1     (36) PPQQVKAL------------------------------
GRMZM2G002874_T01    (38) PPQQ----------------------------------
Bradi5g22410.1       (16) NESRHVRTHLKELSSHVRVLVNRERERGTVYRLQILIASG
GRMZM2G012628_T01    (18) QQQQ----------------------------------
GRMZM2G058098_T02    (20) PQQQ----------------------------------
GRMZM2G426591_T01    (26) PPQQ----------------------------------
Bradi3g15180.1       (22) PQQQ----------------------------------
LOC_Os08g09100.1     (24) PQQQQVRAVLFN--------------------------
AT1G11650.2          (52) PQQQQVGFSY----------------------------
Solyc07g064510.2.1   (48) --------------------------------------
Solyc10g005260.2.1   (68) QMPQQPQ-------------------------------
Solyc02g080420.2.1   (66) QVLQHPQ-------------------------------
Solyc03g031720.2.1   (70) PQ------------------------------------
Eucgr.D01310.1       (56) QQQQLGYS------------------------------
POPTR_0004s01690.1   (54) QVGYS---------------------------------
Glyma07g38940.1      (58) QIGYS---------------------------------
Glyma17g01800.1      (60) QIGYS---------------------------------
Glyma13g27570.1      (62) QIGYS---------------------------------
Glyma15g11380.1      (64) QIGYS---------------------------------
```

Fig. 6AC

```
Eucgr.F03462.1        (50) QPQQ----------------------------------
POPTR_0001s45000.1    (44) QQPGAYQQQPGAYQQQQQVE------------------
POPTR_0011s14150.1    (46) QQQQ----------------------------------
AT4G27000.1           (40) QQQQ----------------------------------
AT5G54900.1           (42) --------------------------------------
```

Fig. 6AD

| | | |
|---|---|---|
| GRMZM2G127510_T01 | (32) | -------- |
| GRMZM2G169615_T01 | (34) | -------- |
| Bradi1g26210.1 | (28) | -------- |
| LOC_Os07g33330.1 | (30) | -------- |
| LOC_Os03g37270.1 | (36) | -------- |
| GRMZM2G002874_T01 | (38) | -------- |
| Bradi5g22410.1 | (16) | KVYLCTVL |
| GRMZM2G012628_T01 | (18) | -------- |
| GRMZM2G058098_T02 | (20) | -------- |
| GRMZM2G426591_T01 | (26) | -------- |
| Bradi3g15180.1 | (22) | -------- |
| LOC_Os08g09100.1 | (24) | -------- |
| AT1G11650.2 | (52) | -------- |
| Solyc07g064510.2.1 | (48) | -------- |
| Solyc10g005260.2.1 | (68) | -------- |
| Solyc02g080420.2.1 | (66) | -------- |
| Solyc03g031720.2.1 | (70) | -------- |
| Eucgr.D01310.1 | (56) | -------- |
| POPTR_0004s01690.1 | (54) | -------- |
| Glyma07g38940.1 | (58) | -------- |
| Glyma17g01800.1 | (60) | -------- |
| Glyma13g27570.1 | (62) | -------- |
| Glyma15g11380.1 | (64) | -------- |

Fig. 6AE

```
Eucgr.F03462.1       (50) ---------
POPTR_0001s45000.1   (44) ---------
POPTR_0011s14150.1   (46) ---------
AT4G27000.1          (40) ---------
AT5G54900.1          (42) ---------
```

Fig. 6AF

```
AT5G41030.1              (86)  MVMEPK--------KNQNLPSF-------------LNP--
GRMZM2G092214_T01        (78)  --MDPKFPTPLALNKTEPTTATTTTTSTA--QHHQLDPKD
GRMZM2G092214_T02        (80)  --MDPKFPTPLALNKTEPTTATTTTTSTA--QHHQLDPKD
GRMZM2G034638_T01        (76)  --MDPKFPPPPPLNKTEPTTATTTTTSTAQQQQQQLDPKD
Bradi2g59240.1           (72)  --MDPKFPPPPPLNKTEPTTGVTTTTTTT--SQQQLDHEQ
LOC_Os01g69980.1         (74)  --MDPKFPPPPPLNKTEPTTTTTNQQHHHDEQ--------
AT3G27010.1              (84)  --MDPKN-------LNRHQ-VPNF------------LNP--
POPTR_0001s13500.1       (102) --MEPKGPNH----HQLQVPSF-------------LNP--
Eucgr.B03529.1           (82)  --MESNGSNQ--QQHQK-----------------------
POPTR_0003s16630.1       (104) --MEPKSPNQ--YQPQ--MPSF-------------LNP--
clementine0.9_018374m    (100) ----------------------------------------
Solyc02g094290.1.1       (106) --MK------------------------------------
Glyma16g05840.1          (92)  --MDPKGSKQQPQQSQEVVPNF------------------
Glyma19g26560.1          (98)  --MDPKGSKQ--QQPQEVVPKFLS----------------
clementine0.9_016144m    (88)  --MDPKASKQ--PSQQE-VANF-------------LNI--
clementine0.9_016174m    (90)  --MDPKASKQ--PSQQE-VANF-------------LNI--
POPTR_0001s33470.1       (92)  --MDPKGSNS--KNPHE-LPTFLTHTHPS-----PPHP--
POPTR_0017s09820.1       (94)  --MDPKGSNS--KNPHE-LPTFFTLTHTHTSPSPSPHT--
```

Fig. 8A

```
AT5G41030.1          (86)  ---------------------------SRQNQDNDKKR
GRMZM2G092214_T01    (78)  YQQTAQHQEQQQHHHHPHLQIQIHQPPPPPQDG-GGGVK
GRMZM2G092214_T02    (80)  YQQTAQHQEQQQHHHHPHLQIQIHQPPPPPQDG-GGGVK
GRMZM2G034638_T01    (76)  YQ--------QQQQPAQHLQIQIHQ---SQQDG-GGGGK
Bradi2g59240.1       (72)  YH----------QPQQHLQIQVHQQQQEED---GGGGK
LOC_Os01g69980.1     (74)  ------------QQQHRLQIQVHPQQQEQQDGGGGGGK
AT3G27010.1          (84)  ------------PPPPRNQGLVDDDAASAVVS-DENRK
POPTR_0001s13500.1   (102) ------------PQKASMPE---------NNI-NNHNK
Eucgr.B03529.1       (82)  -------------------------------------EK
POPTR_0003s16630.1   (104) ------------PQEASMSE---------NNI-NSNNN
clementine0.9_018374m (100) ------------------------------------MAENN
Solyc02g094290.1.1   (106) ------------------------------------RQNTN
Glyma16g05840.1      (92)  --------------LSLPQQQGNTNNN--NMGEN
Glyma19g26560.1      (98)  ------------LPQHHYQQQGNSNNN------NMGEN
clementine0.9_016144m (88)  ------------PQQQQQQPQQL-----QQV-NMGEN
clementine0.9_016174m (90)  ------------PQQQQQQPQQL-----QQV-NMGEN
POPTR_0001s33470.1   (92)  ------------PPQPHLQQPQQLHSQNQQQP-NMGDN
POPTR_0017s09820.1   (94)  ------------PPQPHHQQPQHLHNQNQLQP-NMGEN
```

Fig. 8B

```
AT5G41030.1            (86)  KQTEVKGFDIVVGE---KRKKKENEEEDQEIQILYEKEKK
GRMZM2G092214_T01      (78)  EQQQ----LLQVVA---QPGDRRQ--QALA-------PKR
GRMZM2G092214_T02      (80)  EQQQ----LLQVVA---QPGDRRQ--QALA-------PKR
GRMZM2G034638_T01      (76)  EQQQ-----LQVVA---QPGERRQ--QALA-------PKR
Bradi2g59240.1         (72)  EQQQ----QVVAAA---GAGERRV--QGLG-------PKR
LOC_Os01g69980.1       (74)  DQQQQQMQVVAA---AAGERRM--QGLG-------PKR
AT3G27010.1            (84)  PTTEIKDFQIVVSASDKEPNKKSQNQNQLG-------PKR
POPTR_0001s13500.1     (102) QPAEIKDFQIMIEN---RDHNKKQ----LA-------PKR
Eucgr.B03529.1         (82)  NPSEIKDFQIVIAS---KDESKKQ----LA-------PKR
POPTR_0003s16630.1     (104) KPADIEDFQNMMAD---KDDSKKK----LA-------PKR
clementine0.9_018374m  (100) KPGEIKDFQIMIAN---KDDSTKK----LA-------PKR
Solyc02g094290.1.1     (106) NTMEMKDFQIGIAE---KDEAKKH---QLA-------PKR
Glyma16g05840.1        (92)  KPAEVKDFQIVVAE---NKEESKKQQQLA-------PKR
Glyma19g26560.1        (98)  KPSEVKDFQIVVAA---EKDESKQ--QQLA-------PKR
clementine0.9_016144m  (88)  KPAEIKDFQIVIAD---KEEQTKK---QLA-------PKR
clementine0.9_016174m  (90)  KPAEIKDFQIVIAD---KEEQTKK---QLA-------PKR
POPTR_0001s33470.1     (92)  KPAEIKDFQIVVAD---KEEQKKQ----LA-------PKR
POPTR_0017s09820.1     (94)  KAAEIKDFQIVVAD---KEEQKKQ----LA-------PKR
consensus              (847)                                         KX
```

Fig. 8C

| | | |
|---|---|---|
| AT5G41030.1 | (86) | KPNKDRHLKVEGRGRRVRLPPLCAARIYQLTKELGHKSDG |
| GRMZM2G092214_T01 | (78) | SSNKDRHTKVDGRGRRIRMPALCAARIFQLTRELGHKSDG |
| GRMZM2G092214_T02 | (80) | SSNKDRHTKVDGRGRRIRMPALCAARIFQLTRELGHKSDG |
| GRMZM2G034638_T01 | (76) | SSNKDRHTKVDGRGRRIRMPALCAARIFQLTRELGHKSDG |
| Bradi2g59240.1 | (72) | SSNKDRHTKVDGRGRRIRMPALCAARIFQLTRELGHKSDG |
| LOC_Os01g69980.1 | (74) | SSNKDRHTKVDGRGRRIRMPALCAARIFQLTRELGHKSDG |
| AT3G27010.1 | (84) | SSNKDRHTKVEGRGRRIRMPALCAARIFQLTRELGHKSDG |
| POPTR_0001s13500.1 | (102) | SSNKDRHKKVDGRGRRIRMPALCAARIFQLTRELGNKSDG |
| Eucgr.B03529.1 | (82) | SSNKDRHKKVDGRGRRIRMPALCAARIFQLTRELGHKTDG |
| POPTR_0003s16630.1 | (104) | SSNKDRHKKVEGRGRRIKIPALCAARIFQLTRELEHKSDG |
| clementine0.9_018374m | (100) | SSNKDRHKKVDGRGRRIRMPALCAARIFQLTRELGHKSDG |
| Solyc02g094290.1.1 | (106) | KSNKDRHTKVEGRGRRIRMPALCAARIFQLTRELGHKSDG |
| Glyma16g05840.1 | (92) | SSNKDRHTKVEGRGRRIRMPALCAARIFQLTRELGHKSDG |
| Glyma19g26560.1 | (98) | SSNKDRHTKVEGRGRRIRMPALCAARIFQLTRELGHKSDG |
| clementine0.9_016144m | (88) | SSNKDRHTKVEGRGRRIRMPALCAARIFQLTRELGHKSDG |
| clementine0.9_016174m | (90) | SSNKDRHTKVEGRGRRIRMPALCAARIFQLTRELGHKSDG |
| POPTR_0001s33470.1 | (92) | SSNKDRHTKVEGRGRRIRMPALCAARIFQLTRELGHKSDG |
| POPTR_0017s09820.1 | (94) | SSNKDRHTKVEGRGRRIRMPALCAARIFQLTRELGHKSDG |
| consensus | (847) | XXNKDRHXKVXGRGRRXRXPXLCAARIXQLTXELXXKXDG |

Fig. 8D

| | | |
|---|---|---|
| AT5G41030.1 | (86) | ETLEWLLQHAEPSILSATVNGIKPTESVVSQPPLTADLMI |
| GRMZM2G092214_T01 | (78) | ETVQWLLQQAEPAIVAATGTGTIPASALASVAPSLP---- |
| GRMZM2G092214_T02 | (80) | ETVQWLLQQAEPAIVAATGTGTIPASALASVAPSLP---- |
| GRMZM2G034638_T01 | (76) | ETVQWLLQQAEPAIVAATGTGTIPASALASVAPSLP---- |
| Bradi2g59240.1 | (72) | ETVQWLLQQAEPAIVAATGSGTIPASALASVAPSLP---- |
| LOC_Os01g69980.1 | (74) | ETVQWLLQQAEPAIVAATGTGTIPASALASVAPSLP---- |
| AT3G27010.1 | (84) | ETIQWLLQQAEPSIIAATGSGTIPASALASSAATSNHHQG |
| POPTR_0001s13500.1 | (102) | ETIQWLLQQAEPSIIAATGTGTFPASALAVAGASVS-EQG |
| Eucgr.B03529.1 | (82) | ETIQWLLQQAEPSIVAATGTGTVPASALNAAGSSVS-EQG |
| POPTR_0003s16630.1 | (104) | ETIQWLLQQAEPSIIAATGTGTIPASALAAAGASVS-EQG |
| clementine0.9_018374m | (100) | ETIQWLLQQAEPSIIAATGTGTIPASMLAAAGASVS-EQG |
| Solyc02g094290.1.1 | (106) | ETIQWLLQKAEPSIIAATGHGTIQAS-------------- |
| Glyma16g05840.1 | (92) | ETIQWLLQQAEPSIIAATGTGTIPASALAAAGNSLS-PQA |
| Glyma19g26560.1 | (98) | ETIQWLLQQAEPSIIAATGTGTIPASALAAAGNSLS-PQG |
| clementine0.9_016144m | (88) | ETIQWLLQQAEPSIIAATGTGTIPASALAAAGGSVS-QQG |
| clementine0.9_016174m | (90) | ETIQWLLQQAEPSIIAATGTGTIPASALAAAGGSVS-QQG |
| POPTR_0001s33470.1 | (92) | ETIQWLLQQAEPSIIAATGTGTIPASALAAAGGAIS-QQG |
| POPTR_0017s09820.1 | (94) | ETIQWLLQQAEPSIIAATGTGTIPASALAAAGGAIS-QQG |
| consensus | (847) | ETXXWLLQXAEPXIXXATXX |

Fig. 8E

```
AT5G41030.1          (86)  CHSVEEA-----------------------------S
GRMZM2G092214_T01    (78)  -SPTSGL-----------------------------A
GRMZM2G092214_T02    (80)  -SPTSGL-----------------------------A
GRMZM2G034638_T01    (76)  -SPTSGL-----------------------------A
Bradi2g59240.1       (72)  -SPTSAL-----------------------------A
LOC_Os01g69980.1     (74)  -SPNSAL-----------------------------S
AT3G27010.1          (84)  GSLTAGL----MISHDLDGGSSSSGRPLNW-GIGGGEGVS
POPTR_0001s13500.1   (102) NSVSTGLH---TKMEGLGPAVVGSRDRTNW-TMMNTNL-G
Eucgr.B03529.1       (82)  SSVSAKM----EGLAGVGPLL-GFGGRTNL-AISNGNF-S
POPTR_0003s16630.1   (104) GSVSTGLH---AKMEGLGPGVTGSRDRNDW-TLSNTKL-G
clementine0.9_018374m (100) NSVSAGLH---AKIEGLGPGV-GSINRANW-TMMSANF-G
Solyc02g094290.1.1   (106) ----------------------------------------
Glyma16g05840.1      (92)  ASLSSSLHQHQQKIDELGGSG-GSSSRASW-QMVGGNL-G
Glyma19g26560.1      (98)  SSLSSALHHQHQKIDELGCGS-GGSSRASW-QMVGGNL-G
clementine0.9_016144m (88)  ASLTAGLH---QKIDDLG------SSRTSWGGLVGGNLVG
clementine0.9_016174m (90)  ASLTAGLH---QKIDDLG------SSRTSWGGLVGGNLVG
POPTR_0001s33470.1   (92)  ASLSAGLH---QKIDDLGG----SSSSRASW-AMLGGNL-G
POPTR_0017s09820.1   (94)  ASLSAGLH---QKIDDIGE----SSSRRTSW-AMLGGNL-G
```

Fig. 8F

```
AT5G41030.1            (86)  RTQM-----EANGLW-------------------------
GRMZM2G092214_T01      (78)  RPHHH----HPHHMW-APSAGFSSPSFL------------
GRMZM2G092214_T02      (80)  RPHHH----HPHHMW-APSAGFSSPSFL------------
GRMZM2G034638_T01      (76)  RPH------HHMW-APSAGFSSPSFL--------------
Bradi2g59240.1         (72)  RPH------HHHHLWGPSAAGFSPAGFM------------
LOC_Os01g69980.1       (74)  RSHH-----HHHHMW-AAAPPTASAGFA------------
AT3G27010.1            (84)  RSS------LPTGLW-PNVAGFGS----------------
POPTR_0001s13500.1    (102)  RSN------VASGVW-PSVGGI-GSGFV------------
Eucgr.B03529.1         (82)  RSQ------VVSGVW-PPVSGI-RPGLV---------HYP
POPTR_0003s16630.1    (104)  ISN------VATGVW-PSVGGI-GLGFV------------
clementine0.9_018374m (100)  RSQ------IPSGVW-PTINGT-GSGFI------------
Solyc02g094290.1.1    (106)  --------------LY------------------------
Glyma16g05840.1        (92)  RPHLGVGVATAAGLW-PPHVS--GFGFQTPPTTTPTTTT
Glyma19g26560.1        (98)  RPHLGV---ATTGLWPPHVSGF---GFQ----TATTTTT
clementine0.9_016144m  (88)  RSHQM----PAAGLWPQPVSGF---GFQ----------SS
clementine0.9_016174m  (90)  RSHQM----PAAGLWPQPVSGF---GFQ----------SS
POPTR_0001s33470.1     (92)  RPHHV----TTAGLW-PPVGGY---GFQ---------SSS
POPTR_0017s09820.1     (94)  RPHQV----TSAGLW-PPVGGY---GFQ---------SSS
```

Fig. 8G

```
AT5G41030.1          (86)  ------RNET----GQ------TIGGFDLNYGI--GFDFNG-
GRMZM2G092214_T01    (78)  ---NSAGAGD----GT------GIGGIMQRMGVPAGLELPG-
GRMZM2G092214_T02    (80)  ---NSAGAGD----GT------GIGGIMQRMGVPAGLELPG-
GRMZM2G034638_T01    (76)  ---NSAAAGT----G-------DAAGIMQRMGIPAGFELPGA
Bradi2g59240.1       (72)  -NSAPAGADS----GG------GLGGLMQRIGLPAGMELPG-
LOC_Os01g69980.1     (74)  -GAGFSGADS----GV-------IGGIMQRMGIPAGIELQGG
AT3G27010.1          (84)  ---GVPTTGL----MS------EGAGY--RIGFP-GFDFPG-
POPTR_0001s13500.1   (102) PNSGQSTSNF----GN------ENSTTLPKIG---AWTPTG-
Eucgr.B03529.1       (82)  DQSAAVGANI----GG------ESSNYVSKFGFQ-GVEFPN-
POPTR_0003s16630.1   (104) PNSGQSTSNF----GN------ENSSTLPKYGFQ-GVEFPN-
clementine0.9_018374m (100) QNSGQLTSNF----GS------ENLSANPKFGFH-GIEFPN-
Solyc02g094290.1.1   (106) -------------------------RRLD------------
Glyma16g05840.1      (92)  SSSGPSNATL----AT------ESSNYLQKIAFP-GFDLPT-
Glyma19g26560.1      (98)  TSSGPSNATL----AT------ESSNYLQKIAFP-GFDLPT-
clementine0.9_016144m (88)  SSSGPSTGNL----GT------ENSNYLQKMGFP-GFDLPG-
clementine0.9_016174m (90)  SSSGPSTGNL----GT------ENSNYLQKMGFP-GFDLPG-
POPTR_0001s33470.1   (92)  NSTGPSTTNI---GTEAAAGGSSYLQKLGFP-GFDLPG-
POPTR_0017s09820.1   (94)  NTTGPSTTNIVSEGG-----GGSSYLQKNGFS-GFDMPG-
```

Fig. 8H

| | | |
|---|---|---|
| AT5G41030.1 | (86) | ----------VPEIGFG-------------DNQTPGLE |
| GRMZM2G092214_T01 | (78) | --------GGAAGGHIGFAPMF----AGH---AAAMPGLE |
| GRMZM2G092214_T02 | (80) | --------GGAAGGHIGFAPMF----AGH---AAAMPGLE |
| GRMZM2G034638_T01 | (76) | SA---AGATLGAGGHIGFAPMF----AGH---AAAMPGLE |
| Bradi2g59240.1 | (72) | --------GGGGGHIGFAPMF----ASHAAAAAMPGLE |
| LOC_Os01g69980.1 | (74) | GAGGLGGGGGGGGHIGFAPMF----ASHAAAAAMPGLE |
| AT3G27010.1 | (84) | ------------VGHMSFASIL----GGN---HNQMPGLE |
| POPTR_0001s13500.1 | (102) | ---------------WAWW---------DVQSSSFE |
| Eucgr.B03529.1 | (82) | ----------MNVGLISFPTFL----SGS---NQRMPGLE |
| POPTR_0003s16630.1 | (104) | ----------INMGLMSFYSMF----SGT---NQQLPGLE |
| clementine0.9_018374m | (100) | ----------MNMGLMSFSSML----SGA---SHQIPGLE |
| Solyc02g094290.1.1 | (106) | -----------------PLF----------------- |
| Glyma16g05840.1 | (92) | ------SATNMMGHMSFTSILGGGGGGG---AQHMPGLE |
| Glyma19g26560.1 | (98) | -------SATNMGHMSFTSIL----GGA---GSQQMPGLE |
| clementine0.9_016144m | (88) | ----TGTATTNMGPMSFTSIL----GSA---SNQQLPGLE |
| clementine0.9_016174m | (90) | ----TGTATTNMGPMSFTSIL----GSA---SNQQLPGLE |
| POPTR_0001s33470.1 | (92) | ----------NNMGPMSFTSIL----GGG---TQQLPGLE |
| POPTR_0017s09820.1 | (94) | ----------NNIGPMSLTSIL----GVG---SQQLPGLE |

Fig. 8I

```
AT5G41030.1          (86)  LRLSQ---VGVLNPQ-----VFQQMGKEQ-----------
GRMZM2G092214_T01    (78)  LGLSQDGHIGVLAAQ-SISQFYHQVGAAAGGSGQMQHPHG
GRMZM2G092214_T02    (80)  LGLSQDGHIGVLAAQ-SISQFYHQVGAAAGGSGQMQHPHG
GRMZM2G034638_T01    (76)  LGLSQDGHIGVLAAQ-SISQFYHQVGAAAGGGGQMHHAHG
Bradi2g59240.1       (72)  LGLSQEGHIGVLAAQ-SFSQFYHQVG-GAGGSGQLQHPHP
LOC_Os01g69980.1     (74)  LGLSQDGHIGVLAAQ-SLSQFYHQVVV-------------
AT3G27010.1          (84)  LGLSQEGNVGVLNPQ-SFTQIYQQMGQAQAQA----QGRV
POPTR_0001s13500.1  (102)  SLLPADG-AGPWCLK-----FVESRTAARATS--------
Eucgr.B03529.1       (82)  LGLSQDGHGGVLNSHSSLSQIFQQMGQSGGG---------
POPTR_0003s16630.1  (104)  LGLSQDGHSAMLNPQ-ALSPFYHQMVQGRGV---------
clementine0.9_018374m (100) LGLSQDAHVGVMNSQ-AISQFYQQMGHHRSASGSLN----
Solyc02g094290.1.1  (106)  ----------------------------------------
Glyma16g05840.1      (92)  LGLSQDGHIGVLNQQ-ALNQIYQQMN---QAGRVHHHQHQ
Glyma19g26560.1      (98)  LGLSQDGHIGVLNPQ-ALNQIYQQMNHQAQAGRVHQQHQ-
clementine0.9_016144m (88)  LGLSQDGHIGVLNPQ-TLTQIYQQMGHARV----------
clementine0.9_016174m (90)  LGLSQDGHIGVLNPQ-TLTQIYQQMGHARV----------
POPTR_0001s33470.1   (92)  LGLSQDGHIGVLSPQ-ALNQIYQQMGHARV----------
POPTR_0017s09820.1   (94)  LGLSQDGHIGVLSPQ-ALSQIYQQMGQA------------
```

Fig. 8J

```
AT5G41030.1            (86)  PRVLHH------HSHEDQQQSA---------EENGS----
GRMZM2G092214_T01      (78)  HQHHHH------QQQEDGEDDR---------EDGESDDES
GRMZM2G092214_T02      (80)  HQHHHH------QQQEDGEDDR---------EDGESDDES
GRMZM2G034638_T01      (76)  HHHHHH------QQQEDGEDDR---------EDGESDDES
Bradi2g59240.1         (72)  QQHHHHQQPQQQQQEDGEDER----------DEGDSDEES
LOC_Os01g69980.1       (74)  ----------------------------------------
AT3G27010.1            (84)  LHHMHH------NHEEHQQESG---------EKDDSQGSG
POPTR_0001s13500.1    (102)  ----------------------------------------
Eucgr.B03529.1         (82)  --ETVS------VGHHQQQQTP---------DDEGDGSQE
POPTR_0003s16630.1    (104)  --LDSL------NQEKQQEQPP---------DKDDSQGS-
clementine0.9_018374m (100)  ------------QQHQHQQQIS---------DKDDSQGSG
Solyc02g094290.1.1    (106)  ------------RNRE------------------------
Glyma16g05840.1        (92)  HHHQHH------QQQQHHQQTP---------AKDDSQGSG
Glyma19q26560.1        (98)  ------------HQQQQHQQTP---------AKDDSQGSG
clementine0.9_016144m  (88)  ------------HQQQQQQHPQQQQQAAPVNKDDSQGSG
clementine0.9_016174m  (90)  ------------HQQQQQQHPQQQQQAAPVNKDDSQGSG
POPTR_0001s33470.1     (92)  ------------HQQHQQQNP---------SKDDSQGSG
POPTR_0017s09820.1     (94)  ------------RVQQHQQQNP---------SKDDSQGSG
```

Fig. 8K

| | | |
|---|---|---|
| AT5G41030.1 | (86) | --- |
| GRMZM2G092214_T01 | (78) | GQ- |
| GRMZM2G092214_T02 | (80) | GQ- |
| GRMZM2G034638_T01 | (76) | GQ- |
| Bradi2g59240.1 | (72) | GGQ |
| LOC_Os01g69980.1 | (74) | --- |
| AT3G27010.1 | (84) | R-- |
| POPTR_0001s13500.1 | (102) | --- |
| Eucgr.B03529.1 | (82) | SEE |
| POPTR_0003s16630.1 | (104) | RQ- |
| clementine0.9_018374m | (100) | SKQ |
| Solyc02g094290.1.1 | (106) | --- |
| Glyma16g05840.1 | (92) | GQ- |
| Glyma19g26560.1 | (98) | GQ- |
| clementine0.9_016144m | (88) | Q-- |
| clementine0.9_016174m | (90) | Q-- |
| POPTR_0001s33470.1 | (92) | Q-- |
| POPTR_0017s09820.1 | (94) | Q-- |

Fig. 8L

```
Glyma10g27910.1      (114) ----------------------------------
AT3G62090.2          (110) ------------MMFLPTDYC-CRLSDQEYMELVFENGQ
AT2G46970.1          (108) MEAKPLASSSSEPNMISPSSNIKPKLKDEDYMELVCENGQ
clementine0.9_007946m (112) ---------------------------MSNQEFLELVWEDGQ
POPTR_0014s10700.1   (116) ---------------------------MDDRGHMELVWENGQ Glyma10g27910.1      (114) VVTR--------MTPSCEGSFNAKSAR--------------
AT3G62090.2          (110) ILAK--------GQR--SNVSLHNQRTKSIMD---------
AT2G46970.1          (108) ILAK--------IRRPKNNGSFQKQRRQSLLD---------
clementine0.9_007946m (112) LRMRGSSKRTQKSTSSCIDHASRSSNARLENGGNTDTFPP
POPTR_0014s10700.1   (116) VLMR-------VLPSTSSSCTSYTPHPKKNVSEVENNSDGYTT Glyma10g27910.1      (114) ---------------------------------LS
AT3G62090.2          (110) ---------------------------------LYE
AT2G46970.1          (108) ---------------------------------LYE
clementine0.9_007946m (112) K------------------------NENQHESLLE
POPTR_0014s10700.1   (116) KRPRLGTGDSILGDFPLIDDRELAKRDKSSQDDHHPELFS
```

Fig. 10A

```
Glyma10g27910.1      (114) SLYS--LMDF---------------------PVQRDS--
AT3G62090.2          (110) AEYNEDFMKSIIHGGGGAI----TNLGDTQVVPQSHVA--
AT2G46970.1          (108) TEYSEGFKKN---------I----KILGDTQVVPVSQSK--
clementine0.9_007946m (112) ISYKSHFNAFSEHATGYNIDYDDKLRKDSQVVPVHETT--
POPTR_0014s10700.1   (116) ELCETNLNMLLENNEN-NI-YEKNI-TDAHVVPGYKDANW Glyma10g27910.1      (114) ------------ALDNSQPNSHQSN---------------
AT3G62090.2          (110) ------------AAH-------------------------
AT2G46970.1          (108) ------------PQQDKETNEQMNNNKKKLKSSKIE----
clementine0.9_007946m (112) ------------PTPTGNRQSRDSTPLKRPRVKYSPNLLS
POPTR_0014s10700.1   (116) RPGKASEFAAEVPQLTTASNGQLYQSFLEQHKASAPLFHG Glyma10g27910.1      (114) ----------------------------------------
AT3G62090.2          (110) -------------------------------------ETN
AT2G46970.1          (108) -------------------------------------FERN
clementine0.9_007946m (112) LDVLKREP----EKKREQPVNFSLFLRSPALRTSSRRGFS
POPTR_0014s10700.1   (116) LPTSKLQQVDSGSDNHSRLQNLSRILR-PALPKPS-HGSN
```

Fig. 10B

```
Glyma10g27910.1         (114)  --DQNSVINSPKGSPGRQKNPLNSDISNMVPRSEE-----
AT3G62090.2             (110)  MLESNKHVDDSETLKASSSKRMMVDYHNRKKIKFI-----
AT2G46970.1             (108)  VSKSNKCVESSTLIDVSAKGPKNVE------VTTA-----
clementine0.9_007946m   (112)  RAEPEKVQNKPRLLSPAANGSASVKGFQNQLNSAD-----
POPTR_0014s10700.1      (116)  ATRPTSGPGSSRLQQLKSNTDEPPAGCRNLVESGQMVPTY Glyma10g27910.1         (114)  ---------------------------------TTPPDEQSEA
AT3G62090.2             (110)  -----------------------------------PPDEQSVV
AT2G46970.1             (108)  -----------------------------------PPDEQSAA
clementine0.9_007946m   (112)  --------TNAELL---QPVPV---------TVPDVQSEA
POPTR_0014s10700.1      (116)  ASKVFKYFNDQQYLMASQIVPIGPIDRSAEASPPDEQSEA Glyma10g27910.1         (114)  VGHDSIHGSRGQYFNQTSSSARHRAKGKAHDTKQKYCDEG
AT3G62090.2             (110)  --------------------------------ADRSPKL
AT2G46970.1             (108)  --------------------------------VGRSTEL
clementine0.9_007946m   (112)  ---DYSRTS-----------SLPAENTVKRKLDAGKCIEP
POPTR_0014s10700.1      (116)  VLHNYATTSKRCCDRVFGSTSGSAEKKIKGKPDRGKSIDQ
```

Fig. 10C

```
Glyma10g27910.1        (114) LLESSSLCSIGASNNRNVCS-----RTHDDI--DDSTYLS
AT3G62090.2            (110) GFDTSSV---GFTEDS----------------EGSMYLS
AT2G46970.1            (108) YFASSSKFSRGTSRDLSCCS---LKRKYGDIEEEESTYLS
clementine0.9_007946m  (112) PVPSSSLCSLGASNNPACTTFNLKRRYEDT--EVSACPC
POPTR_0014s10700.1     (116) LTATSSICSRGASNDPTSS----LERQYEDT--EGTAYSS Glyma10g27910.1        (114) NN-DEEPEDVVKEKPAWEGTG-VKRSRNAEVHNLCERKRR
AT3G62090.2            (110) SSLDDESDDARPQVPARTRKALVKKRNAEAYNSPERNQR
AT2G46970.1            (108) NNSDDESDDAKTQVHARTRKPVTKRSTEVHKLYERKRR
clementine0.9_007946m  (112) DQYEKKLE--RKAVTVRGSKS-NKKRTPEVHKRYERKRR
POPTR_0014s10700.1     (116) DDLEEE-----EQVPARGSAG-SKRRRATEIHNLSERKRR
Consensus              (848)                       XXRXXEXXXXXERXXR Glyma10g27910.1        (114) DKINKRMRILKELIPNCNKTDKASMLDDAIEYLKTLKLQL
AT3G62090.2            (110) NDINKKMRTLQNLLPNSHKDDNESMLDEAINYMTNLQLQV
AT2G46970.1            (108) DEFNKKMRALQDLLPNCYKDDKASLLDEAIKYMRTLQLQV
clementine0.9_007946m  (112) DKINKKMRALQELIPNCNKVDKASVLEEAIDYLKTLQFQV
POPTR_0014s10700.1     (116) DRINKKMRALQDLIPNSNKVDKASMLGEAIDYLKSLQLQV
Consensus              (848) XXXNKXMRXLXXLXPNXXXKDXXSXLXXAIXYXXXLXXQX
```

Fig. 10D

```
Glyma10g27910.1        (114) QMSMGAGFCMPFMMLPNAAHHMM-------NTPHLHQLM
AT3G62090.2            (110) QMMTMGNRFVIPSMMMPLG-----------PNYSQ-M
AT2G46970.1            (108) QMMSMGNGLIRPPTMLPMG-----------HYSP-M
clementine0.9_007946m  (112) MMSMGTGVCMPSMMLPTGIIGMQQMHAVAPQMSHFPP-M
POPTR_0014s10700.1     (116) QMSMGTRLCMPLMMLPTGMQHIH-----APLLAQFSP-M
Consensus              (848) X Glyma10g27910.1        (114) GLGMG---FRPGTA-MPCSLPQFP-----ITPLHG-ITDN
AT3G62090.2            (110) GLAMGVG-MQMGEQ-------QFLPAHVLGAGLPG-INDS
AT2G46970.1            (108) GLG-----MHMGAAATPTSIPQFLPMNVQATGPFG-MNNA
clementine0.9_007946m  (112) GIGMDGR-MQMGAGCNPA---QFL-----MPPIPGATAVP
POPTR_0014s10700.1     (116) GVGMDTRLMQMGVGCSPA---TFP-----ASGM-------

Glyma10g27910.1        (114) RVHMFGFP-NQVPPMPISHAP-FIPM-LGNPSTQPTPLAT
AT3G62090.2            (110) AD-MLRFL-NHPGLMPMQNSAPFIPT---ENCSPQSVPPS
AT2G46970.1            (108) PPQMLSFL-NHP-SGLIPNTPIFSPL---ENCSQPFVVPS
clementine0.9_007946m  (112) GIQMPGFP-GQPLPMSMLRTP-LGLMHKTNPVAGVSRAAA
POPTR_0014s10700.1     (116) ---FGLPAGQMLPMSVSQAP-FPPLNIGGHSTHSSVPMP
```

Fig. 10E

```
Glyma10g27910.1       (114) STNINLAENPASSQEEIKF-SMSKAIARKVDLKIVGSDNK
AT3G62090.2           (110) C-----AAFPNQIPNPNSLSNLDGATLHKKSR--------
AT2G46970.1           (108) CVSQTQATSFTQFPKSASASNLEDAMQYRGSNGF----S
clementine0.9_007946m (112) SMEV-KDSAPLTNPGDSNQ-NVEINKRNVEHHKI------
POPTR_0014s10700.1    (116) AMSG-VASTPLEFMRSAVF-PSSKDIIHSNT---------

Glyma10g27910.1       (114) YSATRH
AT3G62090.2           (110) --KTNR
AT2G46970.1           (108) YYRSPN
clementine0.9_007946m (112) --RPSA
POPTR_0014s10700.1    (116) --SARK
```

Fig. 10F

| | | |
|---|---|---|
| Eucgr.B02313.1 | (136) | ---------------------------------- |
| AT5G59570.1 | (128) | ---------------------------------- |
| AT3G46640.3 | (126) | ---------------------------------- |
| clementine0.9_013078m | (130) | ---------------------------------- |
| clementine0.9_013095m | (132) | ---------------------------------- |
| clementine0.9_013088m | (134) | ---------------------------------- |
| Solyc06g076350.2.1 | (146) | ---------------------------------- |
| GRMZM2G067702_T01 | (122) | ---------------------------------- |
| LOC_Os01g74020.1 | (120) | ---------------------------------- |
| Bradi2g62067.1 | (118) | ---------------------------------- |
| Si002653m | (124) | ---------------------------------- |
| POPTR_0001s25040.1 | (138) | ---------------------------------- |
| POPTR_0009s03990.1 | (140) | ---------------------------------- |
| POPTR_0009s03990.2 | (142) | ---------------------------------- |
| Solyc06g005680.2.1 | (144) | ---------------------------------- |
| GSVIVT01024916001 | (154) | MKLQLPPLINISFLSSFQIFFSQFSFLSTLGFFLPLNAK |
| Glyma11g14490.1 | (148) | ---------------------------------- |
| Glyma11g14490.2 | (150) | ---------------------------------- |
| Glyma12g06410.1 | (152) | ---------------------------------- |

Fig. 12A

```
Eucgr.B02313.1      (136)  ----------------------------------------
AT5G59570.1         (128)  ----------------------------------------
AT3G46640.3         (126)  ----------------------------------------
clementine0.9_013078m (130) --------------------------------------
clementine0.9_013095m (132) --------------------------------------
clementine0.9_013088m (134) --------------------------------------
Solyc06g076350.2.1  (146)  ----------------------------------------
GRMZM2G067702_T01   (122)  ----------------------------------------
LOC_Os01g74020.1    (120)  ----------------------------------------
Bradi2g62067.1      (118)  ----------------------------------------
Si002653m           (124)  ----------------------------------------
POPTR_0001s25040.1  (138)  ----------------------------------------
POPTR_0009s03990.1  (140)  ----------------------------------------
POPTR_0009s03990.2  (142)  ----------------------------------------
Solyc06g005680.2.1  (144)  ----------------------------------------
GSVIVT01024916001   (154)  IHQIIHSKIHQIPASSYSPYLWPTILGFCGAIWTISLLGF
Glyma11g14490.1     (148)  ----------------------------------------
Glyma11g14490.2     (150)  ----------------------------------------
Glyma12g06410.1     (152)  ----------------------------------------
```

Fig. 12B

```
Eucgr.B02313.1          (136) ---------------------------------MSESDDLRH
AT5G59570.1             (128) ---------------------------------MGKEVMVSD
AT3G46640.3             (126) ---------------------------------MGEEVQMSD
clementine0.9_013078m   (130) ---------------------------------MGEEVRMTE
clementine0.9_013095m   (132) ---------------------------------MGEEVRMTE
clementine0.9_013088m   (134) ---------------------------------MGEEVRMTE
Solyc06g076350.2.1      (146) ---------------------------------MGEEVSLTD
GRMZM2G067702_T01       (122) ---------------------------------MGEEA-VDD
LOC_Os01g74020.1        (120) ---------------------------------MGEEA-PEE
Bradi2g62067.1          (118) ---------------------------------MGEEA----
Si002653m               (124) ---------------------------------MGEEA-VDD
POPTR_0001s25040.1      (138) --------------------------------------MSE
POPTR_0009s03990.1      (140) ---------------------------------MGEEVKMSE
POPTR_0009s03990.2      (142) ---------------------------------MGEEVKMSE
Solyc06g005680.2.1      (144) ---------------------------------MGEEVKITD
GSVIVT01024916001       (154) ISRTLFWRHRGIIRGWCMSFQRWVLSSTNSMGEEVRMSD
Glyma11g14490.1         (148) ---------------------------------MGEEVKTSE
Glyma11g14490.2         (150) ---------------------------------MGEEVKTSE
Glyma12g06410.1         (152) ---------------------------------MGEEVKTSE
```

Fig. 12C

```
Eucgr.B02313.1         (136) GRGGGSGDGELDGEDPVAEWEFGLPSCDDLAPLSQALIPP
AT5G59570.1            (128) YGDDDGEDAGGGDEYRIPEWEIGLPNGDDLTPLSQYLVPS
AT3G46640.3            (126) YDV-------SGDGDRVSEWEMGLPSDEDLASLSYSLIPP
clementine0.9_013078m  (130) YEVNDKGDY-NGDDERIPEWEMGLPNGTDLTPLSQSLIPP
clementine0.9_013095m  (132) YEVNDKGDY-NGDDERIPEWEMGLPNGTDLTPLSQSLIPP
clementine0.9_013088m  (134) YEVNDKGDY-NGDDERIPEWEMGLPNGTDLTPLSQSLIPP
Solyc06g076350.2.1     (146) YESS------GGNDDRLL-WEIGLPDVDDLTPLNMQLIPS
GRMZM2G067702_T01      (122) YELHM-VCYGSDEDERVMEWESGLPGADELTPLSQPLVPP
LOC_Os01g74020.1       (120) YELG------GGEDERVMEWETGLPGADELTPLSQPLVPA
Bradi2g62067.1         (118) ------GGGGGGEYARVSEWETGLPGSDELTPLSQPLVPP
Si002653m              (124) YQLEL-----LGDEERVMEWETGLPGADELTPLSQPLVPP
POPTR_0001s25040.1     (138) YEIND-EDNINRDDERIDVWEMGLPTPYDLTPLSQLLIPP
POPTR_0009s03990.1     (140) YEINDGEENINGDDERVAVWEIGLPTPDDLTPLSQTLIPP
POPTR_0009s03990.2     (142) YEINDGEENINGDDERVAVWEIGLPTPDDLTPLSQTLIPP
Solyc06g005680.2.1     (144) ------GDGYAGDDNRVGEWEDGLPSFDDLTPLSQVLIPP
GSVIVT01024916001      (154) INGGD-----GGDDERVLEWEAGLPAADDLTPLSQPLIPP
Glyma11g14490.1        (148) Y----------DEERVMEWEAGLPTANDLTPLSQPLIPP
Glyma11g14490.2        (150) Y----------DEERVMEWEAGLPTANDLTPLSQPLIPP
Glyma12g06410.1        (152) Y----------DEERVMEWEMGLPTANDLTPLSQPLIPP
```

Fig. 12D

```
Eucgr.B02313.1        (136)  DLASAFSIALRPSRTAGDVNRASRSTLTGLRRCGSTASSQ
AT5G59570.1           (128)  ILALAFSMIPERSRTIHDVNRASQITLSSLRSST----NA
AT3G46640.3           (126)  NLAMAFSITPERSRTIQDVNRASETTLSSLRGGSSG--PN
clementine0.9_013078m (130)  ELASAFSILPVPCRTHLDVNRASQTTLSSIRGSRAH--SL
clementine0.9_013095m (132)  ELASAFSILPVPCRTHLDVNRASQTTLSSIRGSRAH--SL
clementine0.9_013088m (134)  ELASAFSILPVPCRTHLDVNRASQTTLSSIRGSRAH--SL
Solyc06g076350.2.1    (146)  ELAAAFRISPELSKTMTDVNRASQNTFSSLQRWHSQ--DM
GRMZM2G067702_T01     (122)  GLAAAFRIPPEPGRTLLDLHRASEATVARLRRA-----PP
LOC_Os01g74020.1      (120)  GLAAAFRIPPEPGRTLLDVHRASAATVSRLR-------RA
Bradi2g62067.1        (118)  GLAAAFRIPPEPGRTLLDVHRASSATVSRLRSSS----SS
Si002653m             (124)  GLAAAFRIPPEPGRTLLDVHRASAATVSRLR-------SS
POPTR_0001s25040.1    (138)  ELASAFNISPEPHRTPLDVNRASQNTLSNLHG------HL
POPTR_0009s03990.1    (140)  ELASAFSIFPEPHRTPLDVNRACQTTLSNLRG------QL
POPTR_0009s03990.2    (142)  ELASAFSIFPEPHRTPLDVNRACQTTLSNLRG------QL
Solyc06g005680.2.1    (144)  ELASAFRITPEPAKTMTDVNRASESTFSSLRAG-----QL
GSVIVT01024916001     (154)  ELASAFSITPEPCRTLLEVNRASQSTFSTIRG------QS
Glyma11g14490.1       (148)  ELASAFSILPEPHRTLLDVNRASRNTLSTLRGGGGSV-HQ
Glyma11g14490.2       (150)  ELASAFSILPEPHRTLLDVNRASRNTLSTLRGGGGSV-HQ
Glyma12g06410.1       (152)  ELASAFSISPEPHRTLLEVNRASRNTLSTIRGGGSVH-QA
```

Fig. 12E

```
Eucgr.B02313.1         (136)  GFSTNDNFKSFVDDRQSMEVEVEEEEKEEEEEEEEEEEED
AT5G59570.1            (128)  SSVMEEVVDRV--ESSVPGSDP-----------KKQKKSD
AT3G46640.3            (126)  ISSSNNNVEEE--DRVGSSSPG------SDSKKQKTSNGD
clementine0.9_013078m  (130)  SSTDNNNSNNL--KTLTENRDP------MVTETEEQDQNGS
clementine0.9_013095m  (132)  SSTDNNNSNNL--KTLTENRDP------MVTETEEQDQNGS
clementine0.9_013088m  (134)  SSTDNNNSNNL--KTLTENRDP------MVTETEEQDQNGS
Solyc06g076350.2.1     (146)  ASMNNSNFKTF--SYERSREET------VTERDETDLIRE
GRMZM2G067702_T01      (122)  SSPGTSSSPHG-----------------------------
LOC_Os01g74020.1       (120)  SSSSSSSFPAF-------------------------ASKGAGT
Bradi2g62067.1         (118)  SSGGGGSFPTF-----------------------------PSGH
Si002653m              (124)  LGSGGGTPQPF-----------------LHPNQAAAGGGG
POPTR_0001s25040.1     (138)  NALSSNNFKSF--NE-------------------------
POPTR_0009s03990.1     (140)  NALSSINFKSF--NETTGQTHDPIVVDLDNKTGAVDRDGS
POPTR_0009s03990.2     (142)  NALSSINFKSF--NETTGQTHDPIVVDLDNKTGAVDRDGS
Solyc06g005680.2.1     (144)  HML--SEKYNF--N-EGRNGDR------NHENDEMDLTRD
GSVIVT01024916001      (154)  HSFSSNNFKSF------------------------NEERNRE
Glyma11g14490.1        (148)  AFSSSNNNHNY--DGDGDGGVE------EEEDDDDRDGS
Glyma11g14490.2        (150)  AFSSSNNNHNY--DGDGDGGVE------EEEDDDDRDGS
Glyma12g06410.1        (152)  FSSNNNNNHHY--DGDGDGGDE------EEYDDADRDGS
```

Fig. 12F

```
Eucgr.B02313.1        (136) GADKSDSRKSRRIETAEEVDSTPRMDDSQEDPS---EKTS
AT5G59570.1           (128) GGEAA----------AVEDSTAEEGDSGPEDAS---GKTS
AT3G46640.3           (126) GDDGG----------GVDPDSAMAAEEGDSGTEDLSGKTL
clementine0.9_013078m (130) FADSRSKSRRPDC--TEEADSALRTDNSNEDPS---ARTL
clementine0.9_013095m (132) FADSRSKSRRPDC--TEEADSALRTDNSNEDPS---ARTL
clementine0.9_013088m (134) FADSRSKSRRPDC--TEEADSALRTDNSNEDPS---ARTL
Solyc06g076350.2.1    (146) GSDSRKLRRVESGG-TEEADSSLCNENFADDSS---AKTL
GRMZM2G067702_T01     (122) ---------------HQEARGGEGADSAAATTT----NSN
LOC_Os01g74020.1      (120) G--------------ADEAESGGGADGGNGNTN---NSSS
Bradi2g62067.1        (118) G-------------GAASDTGADSAAAASELE----KTS
Si002653m             (124) G-------------GSAAAAGRGDEADSSAAATTANNS
POPTR_0001s25040.1    (138) --------------TTEADSALRTENWVDDPSSAAARTL
POPTR_0009s03990.1    (140) GSEARKLRRVD----SEEEDSALRTDNSAEDPSSAAARTL
POPTR_0009s03990.2    (142) GSEAR------------------------------KTL
Solyc06g005680.2.1    (144) GSESRKTRRLDPEMVTEEADSALRNENCGDDNS---AKTL
GSVIVT01024916001     (154) --------------PAEADSAMRTENSNDDPS---ARTL
Glyma11g14490.1       (148) GPDSRKQRKIDCGA-AEEADSAVQTETSAERTA------V
Glyma11g14490.2       (150) GPDSRKQRKIDCGA-AEEADSAVQTETSAERTA------V
Glyma12g06410.1       (152) GSDSRKQRKIDCGV-AEEADSAVRTETSAERTA------V
```

Fig. 12G

```
Eucgr.B02313.1           (136)  KRPRLVWTPQLHKRFVDVVAHLGIKNAVPKTIMQLMNVEG
AT5G59570.1              (128)  KRPRLVWTPQLHKRFVDVVAHLGIKNAVPKTIMQLMNVEG
AT3G46640.3              (126)  KRPRLVWTPQLHKRFVDVVAHLGIKNAVPKTIMQLMNVEG
clementine0.9_013078m    (130)  KRPRLVWTPQLHKRFVDVVAHLGIKNAVPKTIMQLMNVEG
clementine0.9_013095m    (132)  KRPRLVWTPQLHKRFVDVVAHLGIKNAVPKTIMQLMNVEG
clementine0.9_013088m    (134)  KRPRLVWTPQLHKRFVDVVAHLGIKNAVPKTIMQLMNVEG
Solyc06g076350.2.1       (146)  KRPRLVWTPQLHKRFIEVVAHLGIKGAVPKTIMQLMNVEG
GRMZM2G067702_T01        (122)  RRPRLVWTPQLHKRFVDVVAHLGIKKAVPKTIMELMNVEG
LOC_Os01g74020.1         (120)  KRARLVWTPQLHKRFVEVVAHLGMKNAVPKTIMQLMNVEG
Bradi2g62067.1           (118)  KRPRMVWNPQLHKRFVDVVAHLGIKSAVPKTIMQLMNVEG
Si002653m                (124)  KRPRLVWTPQLHKRFVDVVAHLGIKNAVPKTIMQLMNVEG
POPTR_0001s25040.1       (138)  KRPRLVWTPQLHKRFVDVVGHLGMKNAVPKTIMQWMNVEG
POPTR_0009s03990.1       (140)  KRPRLVWTPQLHKRFVDVVSHLGIKNAVPKTIMQLMNVEG
POPTR_0009s03990.2       (142)  KRPRLVWTPQLHKRFVDVVSHLGIKNAVPKTIMQLMNVEG
Solyc06g005680.2.1       (144)  KRPRLVWTPQLHKRFVDVVAHLGIKNAVPKTIMQLMNVEG
GSVIVT01024916001        (154)  KRPRLVWTPQLHKRFVDVVGHLGIKNAVPKTIMQLMNVEG
Glyma11g14490.1          (148)  KRPRLVWTPQLHKRFVDVVAHLGIKNAVPKTIMQLMNVEG
Glyma11g14490.2          (150)  KRPRLVWTPQLHKRFVDVVAHLGIKNAVPKTIMQLMNVEG
Glyma12g06410.1          (152)  KRPRLVWTPQLHKRFVDVVAHLGIKNAVPKTIMQLMNVEG
Consensus                (849)  RXVWXPQLHKRFXXVVXHLGXKXAVPKTIMXXMNVEG
```

Fig. 12H

```
Eucgr.B02313.1          (136) LTRENVASHLQKYRVYLRRMQGMSSEGL--SSSDQ-LFTS
AT5G59570.1             (128) LTRENVASHLQKYRLYLKRIQGLTTEEDPYSSSDQ-LFSS
AT3G46640.3             (126) LTRENVASHLQKYRLYLKRMQGLTNEGP--SASDK-LFSS
clementine0.9_013078m   (130) LTRENVASHLQKYRLYLKRMQGLSNDDP--SSSDHQLFAS
clementine0.9_013095m   (132) LTRENVASHLQKYRLYLKRMQGLSNDDP--SSSDHQLFAS
clementine0.9_013088m   (134) LTRENVASHLQKYRLYLKRMQGLSNDDP--SSSDHQLFAS
Solyc06g076350.2.1      (146) LTRENVASHLQKYRLYTKRMQ--PNEGP--SSSDH-LLTS
GRMZM2G067702_T01       (122) LTRENVASHLQKYRLYVKRMRG---QGP--SPSDH-IFAP
LOC_Os01g74020.1        (120) LTRENVASHLQKYRLYVKRMQGLSNEGP--SPSDH-IFAS
Bradi2g62067.1          (118) LTRENVASHLQKYRLYVKRMQGLSNEGP--SPSDH-IFAS
Si002653m               (124) LTRENVASHLQKYRLYVKRMQGLSNEGP--SPSDH-IFAS
POPTR_0001s25040.1      (138) LTRENVASHLQKYRLYLKRKQGLSSEGP--SASDQ-LFAS
POPTR_0009s03990.1      (140) LTRENVASHLQKYRLYLKRMQGLSSEGP--SASDQ-LFAS
POPTR_0009s03990.2      (142) LTRENVASHLQKYRLYLKRMQGLSSEGP--SASDQ-LFAS
Solyc06g005680.2.1      (144) LTRENVASHLQKYRLYLKRMQGLSNEGP--SSSDH-LFAS
GSVIVT01024916001       (154) LTRENVASHLQKYRLYLKRMQGLSNEGP--SSSDH-LFAS
Glyma11g14490.1         (148) LTRENVASHLQKYRLYLKRMQGLSNEGP--SASDQ-LFAS
Glyma11g14490.2         (150) LTRENVASHLQKYRLYLKRMQGLSNEGP--SASDQ-LFAS
Glyma12g06410.1         (152) LTRENVASHLQKYRLYLKRMQGLSNEGP--SSSDQ-LFAS
Consensus               (849) LTRENVASHLQKYR
```

Fig. 12I

```
Eucgr.B02313.1        (136)  TPVVH-SLNY------------------------------
AT5G59570.1           (128)  TPVPP-QSFQ------------------------------
AT3G46640.3           (126)  TPVPP-QSFQ------------------------------
clementine0.9_013078m (130)  TPVPP-QCLPYESTNGGPHVGHLCNSNNNNNNGSINNNNN
clementine0.9_013095m (132)  TPVPP-QCLPYESTNGGPHVGHLCNSNNNNNNGSINNNNN
clementine0.9_013088m (134)  TPVPP-QCLPYESTNGGPHVGHLCNSNNNNNNGSINNNNN
Solyc06g076350.2.1    (146)  TPATE-IMRE-----------------SS-----------
GRMZM2G067702_T01     (122)  TPVHG-VAVG------------------------------
LOC_Os01g74020.1      (120)  TPVPHASLHD------------------------------
Bradi2g62067.1        (118)  TPVPP-SLRE------------------------------
Si002653m             (124)  TPVPH-SLVH------------------------------
POPTR_0001s25040.1    (138)  TPVPQ-SLHE------------------------------
POPTR_0009s03990.1    (140)  TPLPQ-SFPE------------------------------
POPTR_0009s03990.2    (142)  TPLPQ-SFPE------------------------------
Solyc06g005680.2.1    (144)  TPVPQ-SLQQ-----------------SG-----------
GSVIVT01024916001     (154)  TPVPQ-SLHE-----------------SG-----------
Glyma11g14490.1       (148)  TPVPQ-SLHD--------------SAPPSNHSNGHGHGHG
Glyma11g14490.2       (150)  TPVPQ-SLHD--------------SAPPSNHSNGHGHGHG
Glyma12g06410.1       (152)  TAVPQ-SLHD------------------------------
```

Fig. 12J

```
Eucgr.B02313.1         (136)  ----VAGSTGHGDGQMPMPTP-VPYGAQPP----MMPMPV
AT5G59570.1            (128)  -------DGGGSNGKLGVPVP-VPSMVPIPGY--------
AT3G46640.3            (126)  ----DIGGGGGSSGNVGVPIP-GAYGTQQMMQMPVY----
clementine0.9_013078m  (130)  NNDGNSNNGSGNSGHVGMA----AYGAP------------
clementine0.9_013095m  (132)  NNDGNSNNGSGNSGHVGMA----AYGAP------------
clementine0.9_013088m  (134)  NNDGNSNNGSGNSGHVGMA----AYGAP------------
Solyc06g076350.2.1     (146)  ----ESGHLRNTNGHMAMPTL-MPYQQQ-MVAMPMMGMP-
GRMZM2G067702_T01      (122)  ----------------------------------------
LOC_Os01g74020.1       (120)  ----------------------------------------
Bradi2g62067.1         (118)  -------------PQVPSAAMAPMYHHHPMG---------
S1002653m              (124)  --------------EPQAQVPAP-IPYFP-----------
POPTR_0001s25040.1     (138)  ----SGGGSCGGGNFGNPIP-MPYHHPATTAGGMMPMPV
POPTR_0009s03990.1     (140)  ----SSDGGGGGNGNFGIPIP-MPYHHP-ATAGGMMPMPV
POPTR_0009s03990.2     (142)  ----SSDGGGGGNGNFGIPIP-MPYHHP-ATAGGMMPMPV
Solyc06g005680.2.1     (144)  ---GNGHS---GNGHSS-----------------------
GSVIVT01024916001      (154)  ---GSVHGNGHGNGHMSVPIP-MPYGQT------MMHMP-
Glyma11g14490.1        (148)  HSNGRGHGHGHGHGHLSVPMMSMPYPPPLMSM--PYPPPM
Glyma11g14490.2        (150)  HSNGRGHGHGHGHGHLSVPMMSMPYPPPLMSM--PYPPPM
Glyma12g06410.1        (152)  --SAPPSAHSNGHGHLPVPMMSMPYPPPMMSM--PYPPPM
```

Fig. 12K

```
Eucgr.B02313.1       (136) -YAMGHGYGHMRMQI----GDLSGFESNQYVT---------
AT5G59570.1          (128) -------GNQMGMQG-----YYQQYSNHGNES---------
AT3G46640.3          (126) ---------AHHMGMQG-----YHHQNHNHDPYH----QNHR
clementine0.9_013078m (130) --------AGMMTAPM-YGMINHQGFHHGHGFDPSMYNMNM
clementine0.9_013095m (132) --------AGMMTAPM-YGMINHQGFHHGHGFDPSMYNMNM
clementine0.9_013088m (134) --------AGMMTAPM-YGMINHQGFHHGHGFDPSMYNMNM
Solyc06g076350.2.1   (146) N------GGHVGMPVGYG--GGPPLGPHHHYN---------
GRMZM2G067702_T01    (122) -----------MVPM------VSGQAYHYLYN---------
LOC_Os01g74020.1     (120) -----------QVPS-----PYHPHPHHHSYN---------
Bradi2g62067.1       (118) --------GGGGGMTG----GYYQPQQQHGGHA--------
S1002653m            (124) ----------MGVSV-----GYHHHHHQYHHA---------
POPTR_0001s25040.1   (138) --------YGHMGIQM----VNDHVHNNNNSNNYQHQQVSM
POPTR_0009s03990.1   (140) --------YGHMGMQM----GNNNGHNNNSSDNHQHHQVSI
POPTR_0009s03990.2   (142) --------YGHMGMQM----GNNNGHNNNSSDNHQHHQVSI
Solyc06g005680.2.1   (144) ------NGHMPMPM-P-------------------------
GSVIVT01024916001    (154) VLGVSHGHGQMGMSG-PG--GYHGYESHHPYN---------
Glyma11g14490.1      (148) MSGMP--HGHMGIPM----PNSSATSAYHPYN---------
Glyma11g14490.2      (150) MSGMP--HGHMGIPM----PNSSATSAYHPYN---------
Glyma12g06410.1      (152) MSGMPHAHGHMGIPM----PNSSATSAYHPYN---------
```

Fig. 12L

```
Eucgr.B02313.1        (136) ----------------QQRDWS---------SNKYGSVAS
AT5G59570.1           (128) ---------------NQYMMQQN-------------KFGTMVT
AT3G46640.3           (126) HHHGAGGNGSWCLQNFLSFAEFS---------TAKSQIAS
clementine0.9_013078m (130) NMGMGMNMNMGMNNMMHQQRDWSVNKHGYGHGHGQGSVVS
clementine0.9_013095m (132) NMGMGMNMNMGMNNMMHQQRDWSVNKHGYGHGHGQGSVVS
clementine0.9_013088m (134) NMGMGMNMNMGMNNMMHQQRDWSVNKHGYGHGHGQGSVVS
Solyc06g076350.2.1    (146) ----------------VVQQRDWS---------GNNFG----
GRMZM2G067702_T01     (122) ----------------------------------------
LOC_Os01g74020.1      (120) --------------------------------NAAYAATVS
Bradi2g62067.1        (118) --------------------------------VYNGYGGGGG
Si002653m             (124) ---------------------------------------G
POPTR_0001s25040.1    (138) NSHQNGYNGNVALLMGNKHRDWN--------GTNYGPYSH
POPTR_0009s03990.1    (140) NGHQNGYNGNVVHGHMFQQRDWN--------GNHYGSYTH
POPTR_0009s03990.2    (142) NGHQNGYNGNVVHGHMFQQRDWN--------GNHYGSYTH
Solyc06g005680.2.1    (144) ----------------MPITWTW---------A----
GSVIVT01024916001     (154) ---------------MLQQRDWS-------------VVS
Glyma11g14490.1       (148) ---------------MLHQRDWP--------------
Glyma11g14490.2       (150) ---------------MLHQRDWP--------------
Glyma12g06410.1       (152) ---------------MLHQRDWP--------------
```

Fig. 12M

```
Eucgr.B02313.1          (136)  YQQTASNEKRF---------
AT5G59570.1             (128)  YPSVGGGDVNDK--------
AT3G46640.3             (126)  VQERIIQSIM----------
clementine0.9_013078m   (130)  YPQHVAPSSDK---------
clementine0.9_013095m   (132)  YPQHVAPSSDK---------
clementine0.9_013088m   (134)  YPQHVAPSSDK---------
Solyc06g076350.2.1      (146)  YYHPVASNDKYVDLDDVI
GRMZM2G067702_T01       (122)  ---GGGGGDR----------
LOC_Os01g74020.1        (120)  SYHHYHHANH----------
Bradi2g62067.1          (118)  YS-QYHHGDQ----------
Si002653m               (124)  YPQAYHHADK----------
POPTR_0001s25040.1      (138)  HPHHAVSNDNM---------
POPTR_0009s03990.1      (140)  HPHQVAPNDNM---------
POPTR_0009s03990.2      (142)  HPHQVAPNDNM---------
Solyc06g005680.2.1      (144)  ---RVSSSV-----------
GSVIVT01024916001       (154)  YP-NVGPNDQ----------
Glyma11g14490.1         (148)  ---HLAPNDK----------
Glyma11g14490.2         (150)  ---HLAPNDK----------
Glyma12g06410.1         (152)  ---HLAPNDK----------
```

Fig. 12N

```
GRMZM2G169580_T01    (160)  ---MLHHHGGAGSPYMAPTTADTGMDPFSPTPA--TRP---
Glyma16g28240.1      (184)  --MQLGDSSV---------------LEISSH--TQP---
Glyma20g30650.1      (186)  -MELIGDTTI----------VMETSSGEAVAAH--DGG---
Solyc11g005380.1.1   (182)  ---MLESSVL-------------------LEN--TAA---
POPTR_0001s31660.1   (178)  -----------------------------------------
POPTR_0019s02650.1   (180)  -----------------------------------------
POPTR_0002s06900.1   (188)  ---MIGDSSV-------------------QA--TSS---
POPTR_0005s21420.1   (190)  ---MLGDSSV-------------------LA--SSS---
POPTR_0005s21410.1   (170)  ---MLGDSSS----------VLATTTTSTPGGG--GGG---
Glyma20g30640.1      (172)  ---MLGDSAL-------------LGGGGGEGGA--SAD---
Solyc04g071360.2.1   (174)  ---MLGVSGL---------------VSSEGGG--DNP---
Solyc12g056510.1.1   (176)  ---MLGVSSS------LIASSNTSITAGA--AGD--GAA---
Bradi3g30457.1       (162)  MQQQQGGGGG---PGQQFGLHPPEMPPFSPAGQRISMA--
Bradi5g17150.1       (158)  ---MQQHQGG-----GSQYGAPPQDMGPFSTA--PPA--
POPTR_0001s45870.1   (166)  MQQGGGERGSSQSQYAVPQQQQQQGDMPLPPST--SAALA
Si034382m            (164)  ---MQQPGMP-----------PFSPAAGTPVGAAATPA--
G634_P77591          (156)  ---MEQGGGG--------------------GGN--EVV---
AT1G33240.1          (168)  ---MEQGGGG--------------------GGN--EVV---
```

Fig. 15A

```
GRMZM2G169580_T01   (160)  ----------AVSVTAIPPPPTMQLRPAGAGPSADFEELP
Glyma16g28240.1     (184)  ----------EMAVTAVVSPPEE-----------------
Glyma20g30650.1     (186)  ----------EVIMMDANSGEEE-----------------
Solyc11g005380.1.1  (182)  ----------GGAVTGADGEASE-----------------
POPTR_0001s31660.1  (178)  -----------MEASTTFPEN-------------------
POPTR_0019s02650.1  (180)  -----------MEASTTFLEN-------------------
POPTR_0002s06900.1  (188)  ----------DVAATATRVAIEG---------------GE
POPTR_0005s21420.1  (190)  ----------DVATTATRVVPEG-------------GEVCE
POPTR_0005s21410.1  (170)  ----------GGAGDHKEAPPLT-----------------
Glyma20g30640.1     (172)  ----------VVAATATHDATTT-----------------
Solyc04g071360.2.1  (174)  ----------ESGGGAGSGGSSE---------------IG
Solyc12g056510.1.1  (176)  ----------ISAAPSQLAPPPQ---------EAPESGGS
Bradi3g30457.1      (162)  ----------EAPSPISSRPPAP---------PGQQQLS
Bradi5g17150.1      (158)  ----------PGPVPLSSRPPAP------TQQQQPTYEELA
POPTR_0001s45870.1  (166)  THMQQQQVVEEASPISSRPPATAATTSGGGVMNLDEFMR
Si034382m           (164)  ----------AAPSPISSRPPEG---------QQQQV
G634_P77591         (156)  ----------EEASPISSRPPANNLEELMRFSAAADDGGL
AT1G33240.1         (168)  ----------EEASPISSRPPANNLEELMRFSAAADDGGL
```

Fig. 15B

| | | |
|---|---|---|
| GRMZM2G169580_T01 | (160) | AGGAGAGAAASLQDDDMQMQADYGASAAGASGSGGNRWPR |
| Glyma16g28240.1 | (184) | VAHDGSDNSDDWDGLGCKFS-----------FGGNRWPR |
| Glyma20g30650.1 | (186) | NNNKGEEGEEEEGDNKI---NSNNN--SL--CGGNRWPR |
| Solyc11g005380.1.1 | (182) | LKNEGGGGGGSVGGGS------EEEDK--NF--SGGNRWPH |
| POPTR_0001s31660.1 | (178) | SNAATGNRDSDEGDEEMRVKAEEGDQ--H---STGNRWPK |
| POPTR_0019s02650.1 | (180) | SSAAAGDWEDEEGDEGMRVQAEEGVQ--C---STANRWPK |
| POPTR_0002s06900.1 | (188) | GGGGGGFGSNSAEEDKTMGVDHEGNR--MN--YGANRWPR |
| POPTR_0005s21420.1 | (190) | VGDAGGFGSNSTEEDKNMGGDHEGDR--MN--YGANRWPR |
| POPTR_0005s21410.1 | (170) | -GGNHEGGSNDVGGEEDKGKI-EGDR--S---YGGSRWPR |
| Glyma20g30640.1 | (172) | TTTGGGGGGSNNSGDDERGRIEEGER--S---FGGNRWPR |
| Solyc04g071360.2.1 | (174) | LGGGSGGGGGSSGG----FMTEDGER--N---SGGNRWPR |
| Solyc12g056510.1.1 | (176) | SEGGGGGGGDLSIGG--------EDGER--N---SGGNRWPR |
| Bradi3g30457.1 | (162) | SNELAGAAAMSFDEEALAAGEEGGG--GG--SGGNRWPR |
| Bradi5g17150.1 | (158) | AASGAGAGSGGFPDDDMLGGDNSGGG--LGA-SGGNRWPR |
| POPTR_0001s45870.1 | (166) | LSGGGGGAEEDIAG-------EDADR--TGGIASGNRWPR |
| Si034382m | (164) | DELAGGGGSFADHEGSMSAGGDEGER--GG--PSGNRWPR |
| G634_P77591 | (156) | GGGGGGGGGGSASS--------------SSGNRWPR |
| AT1G33240.1 | (168) | GGGGGGGGGGSASS--------------SSGNRWPR |
| consensus | (850) | KXRWPX |

Fig. 15C

| | | |
|---|---|---|
| GRMZM2G169580_T01 | (160) | EETLALIRIRTEMDADFRNAPLKAPLWEDVARKLAGLGYH |
| Glyma16g28240.1 | (184) | QETLALLKIRSDMDTVFRDSSLKGPLWEEVSRKLAELGYQ |
| Glyma20g30650.1 | (186) | QETLALLKIRSDMDAVFRDSSLKGPLWEEVARKLSELGYH |
| Solyc11g005380.1.1 | (182) | EETLALLKIRSEMDVAFRDSNLKSPLWDEISRKMAELGYN |
| POPTR_0001s31660.1 | (178) | QETLALLKIRSDMDVAFKDSGLKAPLWEEVSKKLNELGYN |
| POPTR_0019s02650.1 | (180) | QETLALLEIRSDMDVAFRDSVVKAPLWEEVSRKLNELGYN |
| POPTR_0002s06900.1 | (188) | QETLALLKIRSDMDAVFRDSGLKGPLWEEVSRKLAELGYH |
| POPTR_0005s21420.1 | (190) | QETLALLKIRSAMDAVFRDSSLKGPLWEEVSRKLAELGYH |
| POPTR_0005s21410.1 | (170) | QETLALLKIRSGMDVAFRDASVKGPLWEEVSRKLAELGYN |
| Glyma20g30640.1 | (172) | QETLALLRIRSDMDVAFRDASVKGPLWEEVSRKMAELGYH |
| Solyc04g071360.2.1 | (174) | QETLALLKIRSEMDVIFRDSSLKGPLWEEVSRKMADLGFH |
| Solyc12g056510.1.1 | (176) | QETLALLKIRSEMDVVFKDSSLKGPLWEEVSRKLAELGYH |
| Bradi3g30457.1 | (162) | QETLVLLKIRSDMDAAFRDATLKGPLWEEVSRKLAEEGYR |
| Bradi5g17150.1 | (158) | EETLALIRIRSEMDATFRDATLKGPLWEEVSRKLAELGYK |
| POPTR_0001s45870.1 | (166) | QETLALLQIRSEMDAAFRDATLKGPLWEDVSRKLAEMGYK |
| Si034382m | (164) | QETLALLKIRSEMDAAFREAALKGPLWEQVSRKLEAMGYK |
| G634_P77591 | (156) | EETLALLRIRSDMDSTFRDATLKAPLWEHVSRKLLELGYK |
| AT1G33240.1 | (168) | EETLALLRIRSDMDSTFRDATLKAPLWEHVSRKLLELGYK |
| consensus | (850) | XETXXLXXIRXXMDXXFXXXXXXXPLWXXXXXXKXXXXGXX |

Fig. 15D

| | | |
|---|---|---|
| GRMZM2G169580_T01 | (160) | RSAKKCKEKFENVHKYYKRTKDAHAGRQDGKSYRFFSQLE |
| Glyma16g28240.1 | (184) | RSAKKCKEKFENVYKYNKRTKDNKSGKSHGKTYKFFDQLQ |
| Glyma20g30650.1 | (186) | RSAKKCKEKFENVYKYHKRTKESRSGKHEGKTYKFFDQLQ |
| Solyc11g005380.1.1 | (182) | RNAKKCREKFENIYKYHKRTKDGRSGRQTGKNYRFFEQLE |
| POPTR_0001s31660.1 | (178) | RSAKKCKEKFENIYKYHRRTKEGRSGRPNGKTYRFFEQLQ |
| POPTR_0019s02650.1 | (180) | RSAKKCKEKFENIYKYHRRTKGSQSGRPNGKTYRFFEQLQ |
| POPTR_0002s06900.1 | (188) | RSAKKCKEKFENVYKYHKRTKEGRTGKSEGKSYKFFDELE |
| POPTR_0005s21420.1 | (190) | RSAKKCKEKFENLYKYHKRTKEGRTGKSEGKTYKFFDELE |
| POPTR_0005s21410.1 | (170) | RSGKKCKEKFENVYKYHKRTKDGRTGKQEGKTYRFFDQLE |
| Glyma20g30640.1 | (172) | RSSKKCKEKFENVYKYHKRTKEGRSGKQDGKTYRFFDQLQ |
| Solyc04g071360.2.1 | (174) | RSSKKCKEKFENVYKYHKRTKDGRASKADGKNYRFFEQLE |
| Solyc12g056510.1.1 | (176) | RSAKKCKEKFENVYKYHRRTKDGRASKADGKTYRFFDQLQ |
| Bradi3g30457.1 | (162) | RNAKKCKEKFENVHKYYKRTKDSRAGRNDGKTYRFFQLE |
| Bradi5g17150.1 | (158) | RNAKKCKEKFENVHKYYKRTKEGRTGRQDGKSYRFFSELE |
| POPTR_0001s45870.1 | (166) | RSAKKCKEKFENVHKYYKRTKEGRAGRQDGKSYRFFSQLE |
| Si034382m | (164) | RSAKKCREKFENVDKYYKRTKDGRAGRGDGKAYRFFSELE |
| G634_P77591 | (156) | RSSKKCKEKFENVQKYYKRTKETRGGRHDGKAYKFFSQLE |
| AT1G33240.1 | (168) | RSSKKCKEKFENVQKYYKRTKETRGGRHDGKAYKFFSQLE |
| consensus | (850) | RXXKKCXEKFENXKYYXXRTKXXXXXXXXGKXYXFFXX |

Fig. 15E

```
GRMZM2G169580_T01   (160) ALHA--------------AAPQPQPPSG-----MTTVQAG
Glyma16g28240.1     (184) ALEN---------QFTTVSYPPKPQPTSTLATTNPLTL--
Glyma20g30650.1     (186) ALEN---------QFTVSYSPKPQPTLATTTNIITL----
Solyc11g005380.1.1  (182) LLDS-------------QSLFSSPPLN-------------
POPTR_0001s31660.1  (178) ALDN-------------TEVLLPPPSS-------------
POPTR_0019s02650.1  (180) ALDK-------------TNALVSPTSS-------------
POPTR_0002s06900.1  (188) AFQN---HPPHSTQPPTLTPPPLPPPKAQTASATI-----
POPTR_0005s21420.1  (190) AFQN---HHSHSAQPPTILAPPLPPPKAQTPTATT-----
POPTR_0005s21410.1  (170) AFES------RPPSLSSPLSLPPQPPKA------------
Glyma20g30640.1     (172) ALEN-----------HSPTPHSPNPSSKPLQSAPSRVVA
Solyc04g071360.2.1  (174) ALENITSHHSLMP-VPSSNTRPPPPPLE--ATPINMAMPM
Solyc12g056510.1.1  (176) ALEN----------NPSSHSNIPPPPLA--ATPITMAMPM
Bradi3g30457.1      (162) ALQG---------ATPGAGASSVPPPAT------------
Bradi5g17150.1      (158) ALHA--------TTTAQHHQEQQLPPVSSAAAPPQLQHA-
POPTR_0001s45870.1  (166) ALQN-------------TGGGGGVSSSISNVSGVAPQLIGT
Si034382m           (164) ALHG---------ASSSPAHPPPPSSLAPTPVAMAP--
G634_P77591         (156) ALNT---------------TPPPPPSH-------------
AT1G33240.1         (168) ALNT----------TPPSSSLDVTPLSVANPILMPSS---
```

Fig. 15F

```
GRMZM2G169580_T01    (160)  ------PHHPMA---------------------------LA
Glyma16g28240.1      (184)  ------PTRPSDHGNKVISYVTTFP-STNPTLISPSPQTN
Glyma20g30650.1      (186)  ------PPPTRPSDTTAISYVTTTVPSTNPTIISPSPQPP
Solyc11g005380.1.1   (182)  ----------------------------HSQINRMETMPVPM
POPTR_0001s31660.1   (178)  -------------------------------DKVHTSMAAALVNP
POPTR_0019s02650.1   (180)  -------------------------------DKDHCLMPSASVIP
POPTR_0002s06900.1   (188)  ------TTLPWTNNNTAIVSHATVPSRTNPMDIMSQSIAT
POPTR_0005s21420.1   (190)  ------ATLPWTNSPAIVSHVTVQSTTNPIDILSQGIATP
POPTR_0005s21410.1   (170)  ------PTPAVTAIAMPVVNPSPNIVRASHTIIYLTVPPF
Glyma20g30640.1      (172)  TTTASSMSLPIPIPTTTVPMQPILSNTIPTSSVPNITVPS
Solyc04g071360.2.1   (174)  ------ASSNVQVTASQGTIPHHVTISSAPPPNSLFAPS
Solyc12g056510.1.1   (176)  RSGNNSANPPMPTPTPTPQNHNHFFSVSQKSVVTGAAQPA
Bradi3g30457.1       (162)  ----------------------------AVRAPAEPPP
Bradi5g17150.1       (158)  ------PAAPAVSAPLPMSTMPPPPGPIQPAPISSAAPAA
POPTR_0001s45870.1   (166)  ATTSSLDVAPVSVGIPMPIRTPPPSSQVPQPASNIGSMPP
Si034382m            (164)  ------PATPLPVLQGVPGMAPAMHAEHQPTRVAAVPQPA
G634_P77591          (156)  ----------------------------------------
AT1G33240.1          (168)  ------SSSPFPVFSQPQPQTQTQPPQTHNVSFTPTPPPL
```

Fig. 15G

```
GRMZM2G169580_T01     (160)  W--TAGPTALGPAA---------------GAGLPDLSFSSM
Glyma16g28240.1       (184)  T--TTTTTTTSTT----------------NPRDSSRPQTNN
Glyma20g30650.1       (186)  THATTTTTTSPTV----------------ATNPKNPPQSNN
Solyc11g005380.1.1    (182)  P--MPMTMIKPAAS---------------GCQDFGMDHSRV
POPTR_0001s31660.1    (178)  V--SFIPNAVPCSI---------------QSPGMNFVDT--
POPTR_0019s02650.1    (180)  V--SFIPNDVPCSV---------------QSPRMNCTDA--
POPTR_0002s06900.1    (188)  P--TNNRAISPMPI---------------SSNPINPSQNAY
POPTR_0005s21420.1    (190)  T--TIHSTISPMPL---------------SSNSLNPSQDTL
POPTR_0005s21410.1    (170)  P--STNPTILPPSQ---------------ATNPTNPPHTNT
Glyma20g30640.1       (172)  T--TILPITIPQPILTTIPSINLTIPSYPPSNPTNFPPPSN
Solyc04g071360.2.1    (174)  H--QNAPSSSPVPL---------------PPPPSQQPSPQP
Solyc12g056510.1.1    (176)  V--MTAPALPLSQV---------------PIGNNNLNQMHR
Bradi3g30457.1        (162)  Q--PVVAGAMPTPM---------------GVGNLSFSTSNT
Bradi5g17150.1        (158)  H--VAELHQAPPPL---------------GLQGLSFPSMSE
POPTR_0001s45870.1    (166)  P--DLGATVARAAA---------------AGAPVRISFSSN
Si034382m             (164)  P--LMSGTTAPAAV---------------ASDAACMMTPGD
G634_P77591           (156)  -----------------------------------------
AT1G33240.1           (168)  P----LPSMGPIFT---------------GVTFSSHSSSTA
```

Fig. 15H

```
GRMZM2G169580_T01    (160) SGSESEYDS--------------DDDDDDDAGEEGL---
Glyma16g28240.1      (184) NNNSVTHSLPNMNTSPSTTT----ASTSSSTASDEDLE--
Glyma20g30650.1      (186) NSNIPNYSLLNMNNLFST------TSTSSSTASDEDLE--
Solyc11g005380.1.1   (182) RGFNPGFMS---------------TSTSTTSSSGKESD--
POPTR_0001s31660.1   (178) ------------------------TSTSTASTSSEEEE--
POPTR_0019s02650.1   (180) ------------------------TSTSTASTSSEESE--
POPTR_0002s06900.1   (188) PSSLQNLTTHLLA-----------SSSPSSTASDEELEVS
POPTR_0005s21420.1   (190) PSSLQNLATHLFS-----------SSTSSSTASDEKLEGS
POPTR_0005s21410.1   (170) PPSFPNFSPDLIS-----------NSTSSSTSSDVELQ--
Glyma20g30640.1      (172) PTPPLSFPTDTFSN----------STSSSSTSSDETLE--
Solyc04g071360.2.1   (174) AVNPINNIPQQVNASAMS------YSTSSSTSSDEDIQ--
Solyc12g056510.1.1   (176) PQGNTTTTKTSFLSNS--------TSSSSSTSSDEDIQ--
Bradi3g30457.1       (162) EEFSEDEDEEDDSDDEGTDDMAVVGNKRKRMSSDGVAA--
Bradi5g17150.1       (158) SESDDESEDDEMT-----------AETGGGSGSQDGLGK-
POPTR_0001s45870.1   (166) ESSSSQSSEDDDDDEDEGILGGQTSAMGAGTSRKRKASL
Si034382m            (164) VSFSSGSDGEDTEDT---------GDGGKRKRQGGDVG--
G634_P77591          (156) ----------------------------------------
AT1G33240.1          (168) SGMGSDDDDDDMDVD---------QANIAGSSSRKRKR--
```

Fig. 15I

```
GRMZM2G169580_T01   (160)  -GRGEYHREMMAIFEGMMKQVTDKQDAMQRVFLETLERWE
Glyma16g28240.1     (184)  -ERYRRKRKWKDYFRRLTRKVLLKQEEMQKKFLEAMDQRE
Glyma20g30650.1     (186)  -EKYRKKRKWKDYFRRLTRQVLAKQEEMQKRFLEAIDNRE
Solyc11g005380.1.1  (182)  -GSVKKKRKLASYFERLMKEVLDKQEDLQNKFLEAMEKCE
POPTR_0001s31660.1  (178)  -GTRKKKQKLTGFFERLMKEVIEKQENLQNKFLEAIEKCE
POPTR_0019s02650.1  (180)  -GTRKKKRRLTDFFERLMKEVIEKQENLQNKFLEAIEKCE
POPTR_0002s06900.1  (188)  YKKRKRESNWKDFPERLTRDVIKKQEDLQEKFLETIEKYE
POPTR_0005s21420.1  (190)  -RKRKRKRNWKDFFLRLTRDVIKKQEDLQKKFLETVEKCE
POPTR_0005s21410.1  (170)  -ERRKRKRKWKDFFERLMKEVIQKQEEMQKKFLEAIERRE
Glyma20g30640.1     (172)  -RRRKRKRKWKDFFERLMKEVIEKQEELQKKFLEAIEKRE
Solyc04g071360.2.1  (174)  -RRHKKKRKWKDYFEKFTKDVINKQEESHRRFLEKLEKRE
Solyc12g056510.1.1  (176)  -RRQMKKRKWKEFFESLMKDVIEKQEELQKKFLETLEKRE
Bradi3g30457.1      (162)  -AGGHNNKKMMRFFEGLMRQVMERQEAMQQRFLEAIEKRE
Bradi5g17150.1      (158)  -RKHGGSKKLMAFFEGLMKQVIQRQEEMQRRFLETMEKRE
POPTR_0001s45870.1  (166)  SSSKGETHRMMEFFEGLMKQVMQKQEAMQQRFLEAIEKRE
Si034382m           (164)  -GGGSGSGKMMRFFEGLMRQVMERQEEMQQRFIEAIERRE
G634_P77591         (156)  ----------------------------------------
AT1G33240.1         (168)  -GNRGGGKMMELFEGLVRQVMQKQAAMQRSFLEALEKRE
```

Fig. 15J

```
GRMZM2G169580_P01    (160) AERIAREEAWRRQEVARMNRERERLARERAAAASRDAALI
Glyma16g28240.1      (184) RERVAQQDNWRMQEMARINREHEILVQERSTAAAKDATVI
Glyma20g30650.1      (186) REQVAQQEAWRIQEMARINREHELLVQERSTAAAKNAAVI
Solyc11g005380.1.1   (182) KDRIARDEAWKMQEIARLKKEQEALAHERAISAAKDAAVI
POPTR_0001s31660.1   (178) QERIAREEAWKMQELDRIKRERELLVRERAIAAAKDAAVL
POPTR_0019s02650.1   (180) QERIAREEVWKMQELDRIKREQELLVHERAIAAAKDAAVL
POPTR_0002s06900.1   (188) HERMAREEAWRMQEMARINREHETLIQERSTAAAKDAAVV
POPTR_0005s21420.1   (190) HERMAREDAWRMKEMARMNRQHEILIQERSTAAAKDAAVF
POPTR_0005s21410.1   (170) HERMVREESWRMQEMTRINREREILAQERSVAASKDAAVM
Glyma20g30640.1      (172) HDRIAREEAWRVQEMQRINREREILAQERSIAAAKDAAVM
Solyc04g071360.2.1   (174) HDRMVREEAWKVEEMARMNREHDLLVQERAMAAAKDAAVI
Solyc12g056510.1.1   (176) RDRLMREEAWRVQEMARLNREHDLLVQERSMAAAKDATII
Bradi3g30457.1       (162) QDRMIREEAWRRQEMARLAREQETLAQERAMAASRDAAVL
Bradi5g17150.1       (158) AERMAREEAWRKQEVARLNREQEILAHERAAAASRDASII
POPTR_0001s45870.1   (166) QDRMIRDEAWKRQEMARLSREHEIMAQERSISASRDAAIV
Si034382m            (164) QDRMIREEAWRRQEVARLAREQDALAQERAMAASRDAAVV
G634_P77591          (156) ----------------------------------------
AT1G33240.1          (168) QERLDREEAWKRQEMARLAREHEVMSQERAASASRDAAII
```

Fig. 15K

```
GRMZM2G169580_T01   (160)  AFLQCVGGGQG---------------------QPVRLPPHSA
Glyma16g28240.1     (184)  ALLQKMYGQQN---------------------PT--------
Glyma20g30650.1     (186)  AFLQQLSGQHQ---------------------NSTTTKAGA
Solyc11g005380.1.1  (182)  AFLQKVSDQTI---------------------QLQLPTDL-
POPTR_0001s31660.1  (178)  AFLQKFSEQGI---------------------SVQLPDN--
POPTR_0019s02650.1  (180)  AFLQKFSEQGI---------------------PVQLPDN--
POPTR_0002s06900.1  (188)  AFLQKISGQQN---------------------SVQTQEI--
POPTR_0005s21420.1  (190)  AFLQKISGQQN---------------------STETQAI--
POPTR_0005s21410.1  (170)  AFLQKLSEEQN---------------------PGQIQNN--
Glyma20g30640.1     (172)  SFLQKIAEQQN------LGQALTNINLVQPQPQLQPQPPV
Solyc04g071360.2.1  (174)  SFLQKITEQQNIQIPNSINVGPPSAQV----QIQLPENPL
Solyc12g056510.1.1  (176)  AFLQKITEQQN------TQTPNSTNNTSPSPFPIAQIQL
Bradi3g30457.1      (162)  GFIQKITGQSV---PMPMAPPPPSIAFMPPPPAGSHPTPI
Bradi5g17150.1      (158)  AFLQRVGAGQA-----VQVPAPVVIPMPAPMQVQTPRQPP
POPTR_0001s45870.1  (166)  AFLQKITGQTI---------------HLPTPVSIAPLVS
Si034382m           (164)  SFIQRVTGQTI---PMPSVAPPVFISALTPPPLQPTPVAS
G634_P77591         (156)  ----------------------------------------
AT1G33240.1         (168)  SLIQKITGHTI--------QLPPSLSSQPPPPYQPPPAVT
```

Fig. 15L

```
GRMZM2G169580_T01   (160)  GASVVPA----------PPKPDCAP---PSPRLDAAATS-
Glyma16g28240.1     (184)  ----------------PQVEVEPPPQQKQTIPQSQPPI-
Glyma20g30650.1     (186)  NFLQQPL----------PQQVQPPPQQAPQPLMMSNNNN-
Solyc11g005380.1.1  (182)  ----------------PHRHTEERESESMKTIGNQENV-
POPTR_0001s31660.1  (178)  ----------------PIVPMKFPDNQTVPVPSSAPVQ-
POPTR_0019s02650.1  (180)  ----------------PTVPMKFPDNQTSPALLSKNQA-
POPTR_0002s06900.1  (188)  ----------------PQPTTTPTAPPSQPLQLRPPPS-
POPTR_0005s21420.1  (190)  ----------------PQPKLTPPPTQP-PQPRPPPTS-
POPTR_0005s21410.1  (170)  ----------------PPPSQPPRPPAPPPISPPLQGA-
Glyma20g30640.1     (172)  QQQVT-----------PPNIVPAPMQQPLPVIVTQPVV-
Solyc04g071360.2.1  (174)  SAPVPTQIQPTTVIAAAPPQPAPVPVSLPVTIPAPVPAL-
Solyc12g056510.1.1  (176)  KLSEKPPST-------PPQPQPQPSATAVSLPMTIHTP-
Bradi3g30457.1      (162)  SFSAAPPSSSQSPATQASPRPQKPPMPLPTPAPQKTPVP-
Bradi5g17150.1      (158)  RQQLPPPP---------PPAQATAPPPQPIPAAPLQQQP-
POPTR_0001s45870.1  (166)  QPQPPPPTQPQQVQIAPLVTVSTQPPLQPQPMPLSQVTPQ
Si034382m           (164)  AAPAAAPAQHQQP----PSIHLSPKPGKPHPQPHQTQPP-
G634_P77591         (156)  ----------------PHAHQPEQKQQQQP----------
AT1G33240.1         (168)  KRVAEPPLSTAQSQSQQPIMAIPQQQILPPPPPSHPHAH-
```

Fig. 15M

```
GRMZM2G169580_T01    (160)  ----LQQLV---------------------PAQLK----
Glyma16g28240.1      (184)  ----LMPNN-------------NFEVKKINNGHSVTST---
Glyma20g30650.1      (186)  ----IEIQK-------------MNNGHSVVAAATPTTVV---
Solyc11g005380.1.1   (182)  ----VMQQD---------ND-----------KENID----
POPTR_0001s31660.1   (178)  ----LPKNQ----------------------AVP----
POPTR_0019s02650.1   (180)  ----VP---------------------------------
POPTR_0002s06900.1   (188)  ----LAPV--------------------------------
POPTR_0005s21420.1   (190)  ----LEPVT-------------------------------
POPTR_0005s21410.1   (170)  ----QAPLP-----------------------QAVA----
Glyma20g30640.1      (172)  ----LPVVS---------------------QVTNMEIMK---
Solyc04g071360.2.1   (174)  ----IPSLS---------------------LPLTPPVPSK---
Solyc12g056510.1.1   (176)  ----TPAPP---------------------QTLTLPVVSS---
Bradi3g30457.1       (162)  ----ATPPP-----------------QQQSGGMEMVVSAP----
Bradi5g17150.1       (158)  ----PPPQPQHKETTMARQEAVTTPRSAPTPTPTPASGGT
POPTR_0001s45870.1   (166)  QNKQLPQQQHHQQDDHQQVHHQHQPPSISSEIVMAVP---
Si034382m            (164)  ----LAQLQ-----------------MSSKEMIVRAP----
G634_P77591          (156)  ----------------------------------------
AT1G33240.1          (168)  ----QPEQK-----------------------QQQQP----
```

Fig. 15N

```
GRMZM2G169580_T01    (160)  ------AVEALAWAGGEG-----GGSTSSRWPKEEVEAL
Glyma16g28240.1      (184)  ------TTGTVATATTTTSP---VNSSSSRWPKAEVHAL
Glyma20g30650.1      (186)  ------AATAIATTAVTTTPSSLSSLSSSRWPKTEVHAL
Solyc11g005380.1.1   (182)  ------KQEIDSAGENSN--SF-QTNSSSRWPKAEVEAL
POPTR_0001s31660.1   (178)  ------VENIVKTRENSSIESF-VNISPSRWPKEEIEAL
POPTR_0019s02650.1   (180)  ------VENVVKTHENSSVESF-VNMSSSRWPKEEIESL
POPTR_0002s06900.1   (188)  ------AKLEVPKRDNGD--NF-TVSSSSRWPKVEVQAL
POPTR_0005s21420.1   (190)  ------NLVVSKWDNGENV---TVSSSSRWPKVEVQAL
POPTR_0005s21410.1   (170)  ------NVDMIMKSDNGD-QNF-TSASPSRWPKVEVEAL
Glyma20g30640.1      (172)  ------ADNNNNNNNNNNCENF-LPPSSSRWPKVEVQAL
Solyc04g071360.2.1   (174)  ------NMELVPKSDNGG-DSY-SPASSSRWPKAEVEAL
Solyc12g056510.1.1   (176)  ------KSLEPPKSDNGG-ENF-SPASSSRWPKEEIEAL
Bradi3g30457.1       (162)  ------AGGELQLHDGGS-----GSASSSRWPKAEVHAL
Bradi5g17150.1       (158)  SLALVPVSEQQVESHGLGGGGDHGGAASSSRWPKTEVHAL
POPTR_0001s45870.1   (166)  ------EQQIAPLELGSGG----SEPASSRWPKPEVLAL
Si034382m            (164)  ------PAESQETPGSGG-----GAPSPSRWPKAEVHAL
G634_P77591          (156)  ------QQEMVMSSEQS------SLPSSSRWPKAEILAL
AT1G33240.1          (168)  ------QQEMVMSSEQS------SLPSSSRWPKAEILAL
consensus            (851)                                XSRWPKXEXXXL
```

Fig. 150

| | | |
|---|---|---|
| GRMZM2G169580_T01 | (160) | IQVRNEKDEQYHDAG-GKGPLWEDIAAGMRRIGYNRSAKR |
| Glyma16g28240.1 | (184) | IRIRTSLETKYQENG-PKAPLWEDISIAMQRLGYNRSAKR |
| Glyma20g30650.1 | (186) | IRLRTSLEAKYQENG-PKAPPWEDISAGMLRLGYNRSAKR |
| Solyc11g005380.1.1 | (182) | IKLRTNVDLQYQDNGSSKGPLWEDISCGMKKLGYDRNAKR |
| POPTR_0001s31660.1 | (178) | IGLRTKLEFQYEENG-PKGPLWEEISASMKKLGYDRSAKR |
| POPTR_0019s02650.1 | (180) | IKIRTYLEFQYQENG-PKGPLWEEISTSMKNLGYDRSAKR |
| POPTR_0002s06900.1 | (188) | INLRANLDVKYQENG-AKGPLWEDISAGMQKLGYNRSAKR |
| POPTR_0005s21420.1 | (190) | ISLRADLDIKYQEHG-AKGPLWEDISAGMQKLGYNRSAKR |
| POPTR_0005s21410.1 | (170) | IRIRTNLDCKYQDNG-PKGPLWEEISARMRKLGYNRNAKR |
| Glyma20g30640.1 | (172) | IKLRTSMDEKYQENG-PKGPLWEEISASMKKLGYNRNAKR |
| Solyc04g071360.2.1 | (174) | IKLRTNLDVKYQENG-PKGPLWEEISSGMKKIGYNRNAKR |
| Solyc12g056510.1.1 | (176) | ISLRTCLDLKYQENG-PKGPLWEEISSGMRKIGYNRNAKR |
| Bradi3g30457.1 | (162) | IQLRSNLDTRYQEAG-PKGPLWEEISAGMRRMGYSRSSKR |
| Bradi5g17150.1 | (158) | IQLRMDMDNRYQENG-PKGPLWEEISSGMRRLGYNRNPKR |
| POPTR_0001s45870.1 | (166) | IKLRSGLETRYQEAG-PKGPLWEEISAGMLRLGYKRSSKR |
| S1034382m | (164) | IQLRTELEARYQDSG-PKGPLWEDISAGMRRLGYNRSAKR |
| G634_P77591 | (156) | INLRSGMEPRYQDNV-PKGLLWEEISTSMKRMGYNRAKR |
| AT1G33240.1 | (168) | INLRSGMEPRYQDNV-PKGLLWEEISTSMKRMGYNRAKR |
| consensus | (851) | IXXRXXXXXYXXXXXKXXXWEXIXXXMXXXGYXRXXKR |

Fig. 15P

| | | |
|---|---|---|
| GRMZM2G169580_T01 | (160) | CKEKWENINKYYKKVKESNKRRPEDSKTCPYFHQLDAMYR |
| Glyma16g28240.1 | (184) | CKEKWENINKYFKRVRESSKERREDSKTCPYFHELEALYK |
| Glyma20g30650.1 | (186) | CKEKWENINKYFKKVKESNQRREDSKTCPYFHELEALYK |
| Solyc11g005380.1.1 | (182) | CKEKWENINKYYRRVKESQKKRPEDSKTCPYFHQLDSIYQ |
| POPTR_0001s31660.1 | (178) | CKEKWENMNKYFKRVKESNKRRPGDSKTCPYFQQLDALYR |
| POPTR_0019s02650.1 | (180) | CKEKWENMNKYFKRVKDSNKKRPGDSKTCPYFQQLDALYR |
| POPTR_0002s06900.1 | (188) | CKEKWENINKYFKKVKESNKKRPEDSKTCPYFDQLDALYK |
| POPTR_0005s21420.1 | (190) | CKEKWENINKYFKKVKESNKRRPGDSKTCPYFDQLDALYK |
| POPTR_0005s21410.1 | (170) | CKEKWENINKYFKKVKESKKKRPEDSKTCPYFQQLDALYK |
| Glyma20g30640.1 | (172) | CKEKWENINKYFKKVKESNKRRPEDSKTCPYFHQLDALYR |
| Solyc04g071360.2.1 | (174) | CKEKWENINKYFKKVKESNKKRPEDSKTCPYFHQLDALYK |
| Solyc12g056510.1.1 | (176) | CKEKWENINKYFKKVKESNKKRPEDSKTCPYFHQLEALYK |
| Bradi3g30457.1 | (162) | CKEKWENINKYFKKVKESNKKRPEDSKTCPYFHQLEALYR |
| Bradi5g17150.1 | (158) | CKEKWENINKYFKKVKESNKRRPEDSKTCPYFHQLEAIYR |
| POPTR_0001s45870.1 | (166) | CKEKWENINKYFKKVKESNKKRTEDAKTCPYFHELDALYR |
| Si034382m | (164) | CKEKWENINKYFKKVKESNKKRPEDSKTCPYYHQLEALYR |
| G634_P77591 | (156) | CKEKWENINKYYKKVKESNNSN---------------YN |
| AT1G33240.1 | (168) | CKEKWENINKYYKKVKESNKKRPQDAKTCPYFHRLDLLYR |
| consensus | (851) | CKEKWENXNKYXXVXXSXXXXXXXXXXXXXXXX |

Fig. 15Q

```
GRMZM2G169580_T01    (160) KK---HRGDRGRITAAGPNMQDSPSQRELEGKSSNDVDID
Glyma16g28240.1      (184) EK--------------------------------------
Glyma20g30650.1      (186) EK--------------------------------------
Solyc11g005380.1.1   (182) NK--------------------------------------
POPTR_0001s31660.1   (178) EK--------------------------------------
POPTR_0019s02650.1   (180) EK--------------------------------------
POPTR_0002s06900.1   (188) EK--------------------------------------
POPTR_0005s21420.1   (190) EK--------------------------------------
POPTR_0005s21410.1   (170) EK--------------------------------------
Glyma20g30640.1      (172) QK--------------------------------------
Solyc04g071360.2.1   (174) EK--------------------------------------
Solyc12g056510.1.1   (176) EK--------------------------------------
Bradi3g30457.1       (162) NKQQAALTSPSAAAAPLPALAAPPPPEPFTVAAPISQTPP
Bradi5g17150.1       (158) KK---HNGAGAAAVSAANAAAVASVCAVTTDQQQSLSLN
POPTR_0001s45870.1   (166) KK--------------------------------------
Si034382m            (164) SK---ALAS---SAAPPPPADQQAAGVTVLAAVPLSQTPP
G634_P77591          (156) NK--------------------------------------
AT1G33240.1          (168) NK---VLGSGGGSSTSGLPQDQKQSPVTAMKPPQEGLVNV
```

Fig. 15R

| | | |
|---|---|---|
| GRMZM2G169580_T01 | (160) | ------------------------------------ |
| Glyma16g28240.1 | (184) | ------------------------------------ |
| Glyma20g30650.1 | (186) | ------------------------------------ |
| Solyc11g005380.1.1 | (182) | ------------------------------------ |
| POPTR_0001s31660.1 | (178) | ------------------------------------ |
| POPTR_0019s02650.1 | (180) | ------------------------------------ |
| POPTR_0002s06900.1 | (188) | ------------------------------------ |
| POPTR_0005s21420.1 | (190) | ------------------------------------ |
| POPTR_0005s21410.1 | (170) | ------------------------------------ |
| Glyma20g30640.1 | (172) | ------------------------------------ |
| Solyc04g071360.2.1 | (174) | ------------------------------------ |
| Solyc12g056510.1.1 | (176) | ------------------------------------ |
| Brad13g30457.1 | (162) | TTTHALQQ---PAAAKNGAGNGHGNGNGSGVAACSEGGS |
| Brad15g17150.1 | (158) | RHEIEGKK------------------------------ |
| POPTR_0001s45870.1 | (166) | ------------------------------------ |
| Si034382m | (164) | HAEHGGKDCSNGNGNGCAAGRGGSDNNGGSSGGMQTQASN |
| G634_P77591 | (156) | ------------------------------------ |
| AT1G33240.1 | (168) | QQTHGSAS------------------------------ |

Fig. 15S

```
GRMZM2G169580_T01   (160)  ------NRKSDEQGNVHTS-PVSGNRDTA----PTTTRPP
Glyma16g28240.1     (184)  -------SKSSKNPFGIFQ-NMKPNEMMLMMTEPLMVQPE
Glyma20g30650.1     (186)  -------SKTTQNPFGASFHNMKPHEMME----PLMVQPE
Solyc11g005380.1.1  (182)  -------SKKQLPIMETPGS-NMKAGEILM----QIINQQ
POPTR_0001s31660.1  (178)  -----------NRRVDGSGF-ELKPEELLM----HMMGGQG
POPTR_0019s02650.1  (180)  -----------TRRVDNPSY-ELKPEELLM----HMMGGQE
POPTR_0002s06900.1  (188)  ----------NKMEITVNSDY-AVKPTSTME----PLMVRPE
POPTR_0005s21420.1  (190)  ----------NKMESRVSTGY-AVKPISTME----PLMVSPE
POPTR_0005s21410.1  (170)  --------------NKIDGPS--NMKPENSV----PLMVRPE
Glyma20g30640.1     (172)  -------------HKAEESTA-AAKAESAVA----PLMVQPE
Solyc04g071360.2.1  (174)  --AKNPETASSTSSFNPSF-ALNPDNNQMA---PIMARPE
Solyc12g056510.1.1  (176)  -------AKLEPVPHNTTF-GLTPQNNPPPPPPPIMAQPE
Bradi3g30457.1      (162)  VSAGGMQASNGFFGEAGVA-AKKPEGM-M----KETIMEQ
Bradi5g17150.1      (158)  -------INDNDKRNNGGVG-GATQTQVPT----SNGETTP
POPTR_0001s45870.1  (166)  -------------ILGSSSGGAGSTSTSGFD----SQINRPQ
Si034382m           (164)  GGVAARFSVEGAGGNGVAT-NKQPEGIIT----KETAATT
G634_P77591         (156)  ----------------------------------------
AT1G33240.1         (168)  -----TEEEEPIEESPQG-TEKPEDLVM----RELIQQQ
```

Fig. 15T

```
GRMZM2G169580_T01   (160)  GDGAKNKTAEDNLKRTNVQLKQQQHEFGTDETD-SDDDMA
Glyma16g28240.1     (184)  QQWRPPP------QSLEEGVGMENASEEYHENEENGGDDD
Glyma20g30650.1     (186)  QQWRPPT------QYEQGAAKENNNSERKEREEEEEEEDDD
Solyc11g005380.1.1  (182)  QQQALER---------------------------------
POPTR_0001s31660.1  (178)  DQQQP-------------------ESATTEDR-ESENVD
POPTR_0019s02650.1  (180)  DQQLP-------------------DSATTEDR-ESENVD
POPTR_0002s06900.1  (188)  QQWPFQQ-------ATQPQTIIEDNERNINIDHNIEDDDD
POPTR_0005s21420.1  (190)  QQCPFEQ-------ANQPETIIEDNERDINIDHNIEEDDD
POPTR_0005s21410.1  (170)  QQWPPPQ-------QEHRPDSEMEDLESDDHQNH-DDEDDK
Glyma20g30640.1     (172)  QQWPPQQ----------QDDRDITMEDMENEDDEYEEEREG
Solyc04g071360.2.1  (174)  QQWPLPQ----------HHESTTRIDHENESDN-MDEDDH
Solyc12g056510.1.1  (176)  QQWPIPQ----------NQLHQQNRDHHHDN-ESDSMD
Bradi3g30457.1      (162)  RQQAQAA------PISSSYNNRAGVVDSDNSMDD-EDDYDD
Bradi5g17150.1      (158)  TTTPPLDFSEKKPEDTVRELSEQQQHREFTTDE-TDSDDM
POPTR_0001s45870.1  (166)  KQQHQHQ-----------ESLELDPMPPPMQQTVPQQTQ
Si034382m           (164)  EPRPQPV------SMNDSYVNDT--VDSDSSMDD-DDDEDD
G634_P77591         (156)  ---------------------------------NQ--------
AT1G33240.1         (168)  QQLQQQE---------SMIGEYEKIEESHNYNNMEEEEDQ
```

Fig. 15U

```
GRMZM2G169580_T01    (160)  RN---HTAYTEEDDDEAKIKYKMDFQNPNMIGSSSNMSAP
Glyma16g28240.1      (184)  DN---IEEDGDSVEDEGANPCEIATNN-------------
Glyma20g30650.1      (186)  EN---EEGDLESVEDEGGNRYEIATNKLSSVDTVE-----
Solyc11g005380.1.1   (182)  ------------------TEC-------------------
POPTR_0001s31660.1   (178)  QN---QENYRDKEDGDG---DRIVANDPSSMEIME-----
POPTR_0019s02650.1   (180)  QI---QVDYRGKEDGDG---YGIVAIDPSSLEIMEPYCQE
POPTR_0002s06900.1   (188)  DDVVDDDDVDTDEEDEGGGFEVVANKSAPLVNGDQ----
POPTR_0005s21420.1   (190)  DM---DDDTEEEDEGVG---FEVVANRPASLTNGE-----
POPTR_0005s21410.1   (170)  NM---DDEDEEEDEASG---YEVVANKQTSMNTDE-----
Glyma20g30640.1      (172)  EE---EEEEDEEDEEGGGGNYEIVANKTSGGGAAASVGA
Solyc04g071360.2.1   (174)  DD---EEDEDDEDNNA----YEIVANKQQSSM--AAANTT
Solyc12g056510.1.1   (176)  HD---LEEDEDEDEEDEGNGYEIIITNKQQSSSMAATPVT
Bradi3g30457.1       (162)  ED---EEDDDDDVDGNKMQYEIQFQSQQHHQLHQQHHQH
Bradi5g17150.1       (158)  GD---DYTDGEDGEDDGKMQYRIQFQTPNPVGTNNAPPPA
POPTR_0001s45870.1   (166)  AT---ESQNKNGASVDVQASNTVLAGSPFGEGNGGAEKKK
Si034382m            (164)  FD---DDDEGNVGGGNSKMQYEIQFQRQQQSQ-SSVVRPN
G634_P77591          (156)  ----------------------------------------
AT1G33240.1          (168)  EM---DEEELDEDEKSAA--FEIAFQSPANRGGNGHTEPP
```

Fig. 15V

| | | |
|---|---|---|
| GRMZM2G169580_T01 | (160) | PPPAAAAATTAAAPTT--------------SAAPTSNT |
| Glyma16g28240.1 | (184) | -------------------------------------- |
| Glyma20g30650.1 | (186) | -------------------------------------- |
| Solyc11g005380.1.1 | (182) | -------------------------------------- |
| POPTR_0001s31660.1 | (178) | -------------------------------------- |
| POPTR_0019s02650.1 | (180) | PIRNT-----------------------SHRKRHPC |
| POPTR_0002s06900.1 | (188) | -------------------------------------- |
| POPTR_0005s21420.1 | (190) | -------------------------------------- |
| POPTR_0005s21410.1 | (170) | -------------------------------------- |
| Glyma20g30640.1 | (172) | STE------------------------------------ |
| Solyc04g071360.2.1 | (174) | TSTATTTV------------------------------- |
| Solyc12g056510.1.1 | (176) | TTTSAAAV------------------------------- |
| Bradi3g30457.1 | (162) | NNHNVVRPNAGAAGGGNQPGAAAPPSAASAAAATTTAGSF |
| Bradi5g17150.1 | (158) | TTQTTAVPP--------------------TSTPSSSF |
| POPTR_0001s45870.1 | (166) | TS-------------------------------------- |
| Si034382m | (164) | ASGGAGSGPGGPGP------------------AATASGSF |
| G634_P77591 | (156) | -------------------------------------- |
| AT1G33240.1 | (168) | FLTMVQ---------------------------------- |

Fig. 15W

| | | |
|---|---|---|
| GRMZM2G169580_T01 | (160) | PLAVQ- |
| Glyma16g28240.1 | (184) | ------ |
| Glyma20g30650.1 | (186) | ------ |
| Solyc11g005380.1.1 | (182) | ------ |
| POPTR_0001s31660.1 | (178) | ------ |
| POPTR_0019s02650.1 | (180) | ICIVYM |
| POPTR_0002s06900.1 | (188) | ------ |
| POPTR_0005s21420.1 | (190) | ------ |
| POPTR_0005s21410.1 | (170) | ------ |
| Glyma20g30640.1 | (172) | ------ |
| Solyc04g071360.2.1 | (174) | ------ |
| Solyc12g056510.1.1 | (176) | ------ |
| Bradi3g30457.1 | (162) | LGMVQ- |
| Bradi5g17150.1 | (158) | LAMVQ- |
| POPTR_0001s45870.1 | (166) | ------ |
| Si034382m | (164) | LTMVHH |
| G634_P77591 | (156) | ------ |
| AT1G33240.1 | (168) | ------ |

Fig. 15X

| | | |
|---|---|---|
| Bradi2g29960.1 | (200) | ---------------------------------------- |
| Si022619m | (202) | ---------------------------------------- |
| Si022621m | (204) | ---------------------------------------- |
| Eucgr.G03094.1 | (206) | ---------------------------------------- |
| Solyc06g050520.1.1 | (234) | ---------------------------------------- |
| Glyma02g42960.1 | (224) | ---------------------------------------- |
| Glyma14g06080.1 | (226) | ---------------------------------------- |
| Solyc05g052410.1.1 | (232) | ---------------------------------------- |
| Si002067m | (198) | MRRLAGRRAGGCVTLVGGIGNACVDHAPAPPPTASRQVSR |
| LOC_Os01g07120.1 | (196) | ---------------------------------------- |
| Bradi2g04000.1 | (194) | ---------------------------------------- |
| POPTR_0008s07360.1 | (228) | ---------------------------------------- |
| POPTR_0010s19100.1 | (230) | ---------------------------------------- |
| Glyma12g32400.1 | (212) | ---------------------------------------- |
| Glyma13g38030.1 | (214) | ---------------------------------------- |
| Glyma06g45680.1 | (208) | ---------------------------------------- |
| Glyma12g11150.1 | (210) | ---------------------------------------- |
| Glyma07g19220.1 | (220) | ---------------------------------------- |
| Glyma18g43750.1 | (222) | ---------------------------------------- |
| AT2G40340.1 | (216) | ---------------------------------------- |
| G1755_P4407 | (192) | ---------------------------------------- |
| AT2G40350.1 | (218) | ---------------------------------------- |

Fig. 17A

| | | |
|---|---|---|
| Bradi2g29960.1 | (200) | -MTVDQRSVAAAPLEIPALQPGRTLGAEANTRSHVSVESI |
| Si022619m | (202) | ------------MTVDQKQAMPM---------------- |
| Si022621m | (204) | ------------MTVDQKQAMPM---------------- |
| Eucgr.G03094.1 | (206) | ---------------------------------------- |
| Solyc06g050520.1.1 | (234) | ------------MAIMDEAANMVC---------------- |
| Glyma02g42960.1 | (224) | ------------MGAYDQVSLKPL---------------- |
| Glyma14g06080.1 | (226) | ------------MGAYDQVSLKPL---------------- |
| Solyc05g052410.1.1 | (232) | ---------------------------------------- |
| Si002067m | (198) | TASWRPQNRSGGSVRGRPAAALAAGGNLGRRRRRRVGGG |
| LOC_Os01g07120.1 | (196) | ------------MLFRFVSCNVQLC---------------- |
| Bradi2g04000.1 | (194) | ------------MERGEGKRGAGD---------------- |
| POPTR_0008s07360.1 | (228) | ------------MGTLIQGSNATS---------------- |
| POPTR_0010s19100.1 | (230) | ------------MGTLDQYSKATS---------------- |
| Glyma12g32400.1 | (212) | ---------------------------------------- |
| Glyma13g38030.1 | (214) | ---------------------------------------- |
| Glyma06g45680.1 | (208) | ---------------------------------------- |
| Glyma12g11150.1 | (210) | ---------------------------------------- |
| Glyma07g19220.1 | (220) | ---------------------------------------- |
| Glyma18g43750.1 | (222) | ---------------------------------------- |
| AT2G40340.1 | (216) | ---------------------------------------- |
| G1755_P4407 | (192) | ---------------------------------------- |
| AT2G40350.1 | (218) | ---------------------------------------- |

Fig. 17B

```
Bradi2g29960.1      (200)  GSCTLPCNECELSAQQTPKGVAPVASILRKKRPRRSRDGP
Si022619m           (202)  ------------------------QAQAMQPGSRKKRPRRLRDGP
Si022621m           (204)  ------------------------QAQAMQPGRKKRPRRLRDGP
Eucgr.G03094.1      (206)  ---------------------------MSPEIVERKRSRSRKEGS
Solyc06g050520.1.1  (234)  ---------------------------VPLDYSRKRKSRSRRDRT
Glyma02g42960.1     (224)  -------------------------------DSSRKRKSRSRGDGS
Glyma14g06080.1     (226)  -------------------------------DSSRKRKSRSRGYGT
Solyc05g052410.1.1  (232)  ---------------------------MMLPMDYTRKKKSRSRKDAP
Si002067m           (198)  DLPSLSSMDLGHGAQGGEGDSSGSGGQLRKKRMRRKSTGP
LOC_Os01g07120.1    (196)  ------------------------GIIELPHWVRKKRTRRKSDGP
Bradi2g04000.1      (194)  ----------------------------CSVQERKKKVRRRSTGP
POPTR_0008s07360.1  (228)  ------------------------------MSMDSTKKRKRASD
POPTR_0010s19100.1  (230)  ------------------------------MPTDPTKKRKRVIN
Glyma12g32400.1     (212)  ------------------------------MLAKTHNKGDGS
Glyma13g38030.1     (214)  ------------------------------MLAKAHNKGDGS
Glyma06g45680.1     (208)  ------------------------------MHMLVKNHNKGDGS
Glyma12g11150.1     (210)  ------------------------------MHMLVKNHNKGDGS
Glyma07g19220.1     (220)  ------------------------------ERKSRKRRSGES
Glyma18g43750.1     (222)  ------------------------------ERKSRKRRNGGS
AT2G40340.1         (216)  -----------------------------MPSEIVDRKRKSRGT
G1755_P4407         (192)  ----------------------------MPSASEIVDRKRKSRGT
AT2G40350.1         (218)  --------------------------------MPRKRKSRGT
```

Fig. 17C

```
Bradi2g29960.1      (200) NSVSETIRRWKEVNQQLEHDP----EGAKRARKPPAKGSK
Si022619m           (202) TSVAAVIQRWAEHNKQLEHDS----EGAKRPRKAPAKGSK
Si022621m           (204) TSVAAVIQRWAEHNKQLEHDS----EGAKRPRKAPAKGSK
Eucgr.G03094.1      (206) MSVAETLAKWKQYNDQLDPQA----NGDKPARRVPAKGSK
Solyc06g050520.1.1  (234) KNVEETLAKWKEYNEKLDNEG----KGKPVRKVPAKGSK
Glyma02g42960.1     (224) KSVAETIAKWKEYNEHLYSGK----DDSRTTRKAPAKGSK
Glyma14g06080.1     (226) GSVAETIAKWKEYNEHLYSGK----DDSRTTRKAPAKGSK
Solyc05g052410.1.1  (232) KNVAETLAKWKEVNEKLDACD----DDGRKPVRKVPAKGSK
Si002067m           (198) DSIAETIKWWKEQNQKLQDES--------GSRKAPAKGSK
LOC_Os01g07120.1    (196) DSIAETIKWWKEQNQKLQEEN--------SSRKAPAKGSK
Bradi2g04000.1      (194) DSIAETIKKWKEQNQKLQGEN--------GPRKAPAKGSK
POPTR_0008s07360.1  (228) KSVAETLQKWKEYNEHLDAQG---DGGNKPVRKVPAKGSK
POPTR_0010s19100.1  (230) KSVAETLKKWKEYNEYLDSQG---DGGNKPVRKVPAKGSK
Glyma12g32400.1     (212) KSLAKILAKWKEYNAQIDSSS----DADKPVRKVPAKGSK
Glyma13g38030.1     (214) KSLAKILAKWKEYNAQIDSSS----DADKPIRKVPAKGSK
Glyma06g45680.1     (208) KSLADTLAKWKEYNAWLESNN----EAEKPARKVPAKGSK
Glyma12g11150.1     (210) KSLADTLAKWKEYNAWLESNN----EAEKPVRKVPAKGSK
Glyma07g19220.1     (220) DSVEDTLEKWKEYNRQQLGS--RENGVEVIHKVPAKGSR
Glyma18g43750.1     (222) DYVEDTLEKWKEYNRQQLGS--RENGVEVIHKAPAKGSR
AT2G40340.1         (216) RDVAEILRQWREYNEQIEAESCIDGGGPKSIRKPPPKGSR
G1755_P4407         (192) RDVAEILRKWREYNEQTEADSCIDGGGSKPIRKAPPKRSR
AT2G40350.1         (218) RDVAEILRKWREYNEQTEADSCIDGGGSKPIRKAPPKRSR
```

Fig. 17D

```
Bradi2g29960.1      (200) KGCMQGKGGPENTRCKFRGVRQRTWGKWVAEIREP-----
Si022619m           (202) KGCMKGKGGPENTHCGYRGVRQRTWGKWVAEIREP-----
Si022621m           (204) KGCMKGKGGPENTHCGYRGVRQRTWGKWVAEIREP-----
Eucgr.G03094.1      (206) KGCMKGKGGPENTTFNYRGVRQRTWGKWVAEIREP-----
Solyc06g050520.1.1  (234) KGCMRGKGGPENWRCKYRGVRQRIWGKWVAEIREP-----
Glyma02g42960.1     (224) KGCMKGKGGPQNSQCNYRGVRQRTWGKWVGEIREP-----
Glyma14g06080.1     (226) KGCMKGKGGPQNSQCNYRGVRQRTWGKWVGEIREP-----
Solyc05g052410.1.1  (232) KGCMKGKGGPDNGRCKYRGVRQRTWGKWVAEIREP-----
Si002067m           (198) KGCMAGKGGPENGNCPYRGVRQRTWGKWVAEIREP-----
LOC_Os01g07120.1    (196) KGCMAGKGGPENSNCAYRGVRQRTWGKWVAEIREP-----
Bradi2g04000.1      (194) KGCMAGKGGPENSNCAYRGVRQRTWGKWVAEIREP-----
POPTR_0008s07360.1  (228) KGCMKGKGGPENSVCNYRGVRQRTWGKWVAEIREP-----
POPTR_0010s19100.1  (230) KGCMKGKGGPENSVCNYRGVRQRTWGKWVAEIREP-----
Glyma12g32400.1     (212) KGCMKGKGGPENSRCNYRGVRQRTWGKWVAEIREP-----
Glyma13g38030.1     (214) KGCMKGKGGPENSRCNYRGVRQRTWGKWVAEIREP-----
Glyma06g45680.1     (208) KGCMKGKGGPENSRCNYRGVRQRTWGKWVAEIREP-----
Glyma12g11150.1     (210) KGCMKGKGGPENLRCNYRGVRQRTWGKWVAEIREP-----
Glyma07g19220.1     (220) KGCMRGKGGPQNSDCKFRGVRQRIWGKWVAEIREPINGKL
Glyma18g43750.1     (222) KGCMRGKGGPQNSDCKFRGVRQRIWGKWVAEIREPINGKL
AT2G40340.1         (216) KGCMKGKGGPENGICDYRGVRQRRWGKWVAEIREP-----
G1755_P4407         (192) KGCMKGKGGPENGICDYTGVRQRTWGKWVAEIREP-----
AT2G40350.1         (218) KGCMKGKGGPENGICDYTGVRQRTWGKWVAEIREP-----
consensus           (852)                XXXGVRQRXWGKWVXEIREPXXXXX
```

Fig. 17E

| | | |
|---|---|---|
| Bradi2g29960.1 | (200) | --NRVSRLWLGTFPTAETAACAYDEAARAMYGPLARTNFT |
| Si022619m | (202) | --NRANRLWLGTFPTAEDAARAYDQAARAMYGEVARTNFP |
| Si022621m | (204) | --NRANRLWLGTFPTAEDAARAYDQAARAMYGEVARTNFP |
| Eucgr.G03094.1 | (206) | --NRGSRLWLGTFPTAIEAAKAYDEAATAMYGPCARLNFP |
| Solyc06g050520.1.1 | (234) | --KRGSRLWLGTFGTAIEAALAYDDAARAMYGPCARLNLP |
| Glyma02g42960.1 | (224) | --NRGSRLWLGTFSSAQEAALAYDEAARAMYGPCARLNFP |
| Glyma14g06080.1 | (226) | --NRGSRLWLGTFSSAQEAALAYDEAARAMYGPCARLNFP |
| Solyc05g052410.1.1 | (232) | --HRGRRLWLGTFDTAIEAALAYDEAARAMYGPCARLNLP |
| Si002067m | (198) | --NRGKRLWLGSFPTAVEAAHAYDEAAKAMYGPKARVNFP |
| LOC_Os01g07120.1 | (196) | --NRGRRLWLGSFPTALEAAHAYDEAARAMYGPTARVNPA |
| Bradi2g04000.1 | (194) | --NRGKRLWLGSFPTAVEAAHAYDEAARAMYGAKARVNFS |
| POPTR_0008s07360.1 | (228) | --NRGPRLWLGTFPTAYEAALAYDNAARAMYGSCARLNIP |
| POPTR_0010s19100.1 | (230) | --NRGPRLWLGTFPTAYEAALAYDEAARAMYGPYARLNVP |
| Glyma12g32400.1 | (212) | --NRGNRLWLGTFPTAIGAALAYDEAARAMYGSCARLNFP |
| Glyma13g38030.1 | (214) | --NRGNRLWLGTFPTAIGAALAYDEAARAMYGSCARLNFP |
| Glyma06g45680.1 | (208) | --NRGSRLWLGTFPTAISAALAYDEAARAMYGSCARLNFP |
| Glyma12g11150.1 | (210) | --NRGSRLWLGTFPTAISAALAYDEAAMAMYGFCARLNFP |
| Glyma07g19220.1 | (220) | VGEKANRLWLGTFSTALEAALAYDEAAKAMYGPCARLNFP |
| Glyma18g43750.1 | (222) | VGEKANRLWLGTFSTALEAALAYDEAAKALYGPCARLNFS |
| AT2G40340.1 | (216) | --DGGARLWLGTFSSSYEAALAYDEAAKAIYGQSARLNLP |
| G1755_P4407 | (192) | --GRGAKLWLGTFSSSYEAALAYDEASKAIYGQSARLNLP |
| AT2G40350.1 | (218) | --GRGAKLWLGTFSSSYEAALAYDEASKAIYGQSARLNLP |
| consensus | (852) | XXXXXXXLWLGXFXXXXXAAXAYDXAXXAXYGXXARXNX |

Fig. 17F

```
Bradi2g29960.1      (200) IQDVPTPAVDIPAVVQRLLPGG-------STSCESTMTS-
Si022619m           (202) RQNAVASSQVAWAATPAQVAPSVVEGVVHSTSCESTTTS-
Si022621m           (204) RQNAVASSQVAWAATPAQVAPSVVEGVVHSTSCESTTTS-
Eucgr.G03094.1      (206) TASHPMSFGDLDARATTPV----------GTTANTTGTP-
Solyc06g050520.1.1  (234) NYACDSVSWATTSASAS-------------ASDCTVA----
Glyma02g42960.1     (224) KITDYPSVKESLKDSSMAA-----------SSSCSSAATAA
Glyma14g06080.1     (226) GITDYASFKESLKESPMAA-----------SSSCSSAETAT
Solyc05g052410.1.1  (232) DYYASSKESSKDDSSLPTV-----------SRSDSNTASSF
Si002067m           (198) ENSADANSGCTSALSLL------------------------
LOC_Os01g07120.1    (196) DNSIDANSGCTSAPSLMMS-----------NGPAT------
Bradi2g04000.1      (194) EHSTDANSGCTSA---PSL-----------LMSNGPTTAS-
POPTR_0008s07360.1  (228) EVVNSTSSSKDNFSAVTPSY----------YSSAASPADSV
POPTR_0010s19100.1  (230) DVLNSTSSSKDNFSSA--------------TPSCYSPAASS
Glyma12g32400.1     (212) NVSVSSFSEESSKDSPVA-----------------------
Glyma13g38030.1     (214) NVSVSSFSEESSKDSPSA-----------------------
Glyma06g45680.1     (208) NVQVSTLSEESSRNSPAAA-----------NRSRNSPAAS-
Glyma12g11150.1     (210) NVQVSTFSEEPSRNSPAAA-----------YQSRNSPSAK-
Glyma07g19220.1     (220) EPIDSNGSSSSSG----------------------------
Glyma18g43750.1     (222) ESIDSNGSSSSSGKNGCDVAKAEELEVN-RHRCHEEKPRF
AT2G40340.1         (216) EITNRSSTAATATVSGSVTAFSDESEVCAREDTNASS--
G1755_P4407         (192) LLPLCQ----------------------------------
AT2G40350.1         (218) LLPLCQ----------------------------------
```

Fig. 17G

```
Bradi2g29960.1      (200) -------------------------NH-------SGIVASSRV
Si022619m           (202) -------------------------NH-------SDIASTLHK
Si022621m           (204) -------------------------NH-------SDIASTLHK
Eucgr.G03094.1      (206) ----------------SIGYSAGTPSTGYSAGTP
Solyc06g050520.1.1  (234) ----------------------------------SGFGEVCPV
Glyma02g42960.1     (224) SDTTT----------------TT-------SNQSEVCAV
Glyma14g06080.1     (226) SDTT-----------------TT-------SNQSEVCAA
Solyc05g052410.1.1  (232) SEVC-----------------PAGDMMRGRANVPAARHE
Si002067m           (198) -------------------------AS-------SVPAAALHG
LOC_Os01g07120.1    (196) -------------------------IP-------SDEKDELES
Bradi2g04000.1      (194) -------------------------HP-------SDEKDELES
POPTR_0008s07360.1  (228) TTST-----------------HSEVCAYEDPNQNVLSQA
POPTR_0010s19100.1  (230) ADSA-----------------TT-------STHSEVCVY
Glyma12g32400.1     (212) -------------------------NH-------CGSSMAVSA
Glyma13g38030.1     (214) -------------------------NH-------CGSSMAVSA
Glyma06g45680.1     (208) -------------------------QS-------GHALMILES
Glyma12g11150.1     (210) -------------------------ES-------GSALVILER
Glyma07g19220.1     (220) ----------------------------------SDKKSPSGS
Glyma18g43750.1     (222) SKVGVFEETEEKPILSGGCVADDSIEELKEITTGFEQCQT
AT2G40340.1         (216) -------------------------GF-------GQVKLEDCS
G1755_P4407         (192) ------------------------------------ARL
AT2G40350.1         (218) ------------------------------------ARL
```

Fig. 17H

| | | |
|---|---|---|
| Bradi2g29960.1 | (200) | LEISSSLKQSDVGSEHDQRSNQYSSPQAGSSVARSRADDL |
| Si022619m | (202) | PEVSDLSSSVKVECPEVVEAGSRRSEMVSGTSHQHEDSHP |
| Si022621m | (204) | PEVSDLSSSVKVECPEVVEAGSRRSEMVSGTSHQHEDSHP |
| Eucgr.G03094.1 | (206) | SEATTLSSQSELTGGPEVKDGDRKGESNADGGEMEPKSES |
| Solyc06g050520.1.1 | (234) | DGALHEADTPLSSVKDEGTAMDIVEPTSIDEDTLKSGWDC |
| Glyma02g42960.1 | (224) | EDVIEKPANVNDK--FNDCHKAYVSASPTSRMKQEPKDEA |
| Glyma14g06080.1 | (226) | EDVKENPRLVNVNDKVNDCHKAYEAASPTSRMKQEPKDEA |
| Solyc05g052410.1.1 | (232) | DRSIEIDGARTGSNEIGTPLSSLREEAEDETKEVSDKSET |
| Si002067m | (198) | FNEKDEVESVETE------------------VHEVKAEA |
| LOC_Os01g07120.1 | (196) | PPFIVANGPAVLYQPDKKDVLERVVPE-----VQDVKTEG |
| Bradi2g04000.1 | (194) | PPFVMSSAPTDGLHQPDAKDEYGSAGTL----VHEVKTEV |
| POPTR_0008s07360.1 | (228) | EDWMTNISSQAEVCEQNVSSQAEVYEQNVSSQHIEDCSRG |
| POPTR_0010s19100.1 | (230) | EDPKQNVYSQAEVCGKDVSSQAEVLAHHISSQQHIEDGSQ |
| Glyma12g32400.1 | (212) | NESMISPSNSGVG--------------------------- |
| Glyma13g38030.1 | (214) | NESMISPSNSGVD--------------------------- |
| Glyma06g45680.1 | (208) | SECMILPNNSGGD--------------------------- |
| Glyma12g11150.1 | (210) | SECMMLWNNSGGD--------------------------- |
| Glyma07g19220.1 | (220) | SE-------------------------------------- |
| Glyma18g43750.1 | (222) | SEEQMATTLKNVKSEVPGESEEMERELEEVVKNSGIGGEI |
| AT2G40340.1 | (216) | DEYVLLDSSQCIKEELKGKEEVREEHNLAVGFGIGQDSKR |
| G1755_P4407 | (192) | LHFLMNLKF------------------------------ |
| AT2G40350.1 | (218) | LHFLMNLKF------------------------------ |

Fig. 17I

```
Bradi2g29960.1      (200) FEPLEPIANLPDG---------------------
Si022619m           (202) STQASTPNVGDKEVFEPLEPIANLPEG--------
Si022621m           (204) STQASTPNVGDKEVFEPLEPIANLPEG--------
Eucgr.G03094.1      (206) IVDFDWLSDYA------------------------
Solyc06g050520.1.1  (234) LDKLN------------------------------
Glyma02g42960.1     (224) VDHMDTGAGEIQDVGLEGTHDTGQVAENVNKDQMDLSWID
Glyma14g06080.1     (226) VDHMVPGAGKILDVRPEGTHDAGQVAEDVNKDQMDLPWID
Solyc05g052410.1.1  (232) FTPLSSLREQAEDEAKQVLDKSETFEIKDEPAACSYDSWD
Si002067m           (198) NDDLGSIHVECK-----------------------
LOC_Os01g07120.1    (196) SNGLKRVCQERK-----------------------
Bradi2g04000.1      (194) SNDLRSTCEEHK-----------------------
POPTR_0008s07360.1  (228) VEKNSKLSQDELKIQSENPSWTNDWHSYG------
POPTR_0010s19100.1  (230) GVENSTLRDEQKSQSENPLWTPSENSLWTNDWHNYS---
Glyma12g32400.1     (212) -----------------------------------
Glyma13g38030.1     (214) -----------------------------------
Glyma06g45680.1     (208) -----------------------------------
Glyma12g11150.1     (210) -----------------------------------
Glyma07g19220.1     (220) -----------------------------------
Glyma18g43750.1     (222) LLKSEETRGESVETLNSYTNLRPNPEASIAK----
AT2G40340.1         (216) ETLDAWLMGNGNEQEPLEFG---------------
G1755_P4407         (192) -----------------------------------
AT2G40350.1         (218) -----------------------------------
```

Fig. 17J

```
Bradi2g29960.1        (200)  ---------------EDDGFDIEELLRMMEADP----------
Si022619m             (202)  ---------------DFDGFDIDEMLRMMEADP----------
Si022621m             (204)  ---------------DFDGFDIDEMLRMMEADP----------
Eucgr.G03094.1        (206)  ---------------VDDLFDVDELLRTLESDP----------
Solyc06g050520.1.1    (234)  ---------------MDEMFDVDELLAMLDSTP----------
Glyma02g42960.1       (224)  GFDFIDDYLKSFSADELFQVDELLGLIDNNPIDNSVLMQG
Glyma14g06080.1       (226)  GFDFSDNYLNRFSTDELFQVDELLGLIDNNPIDESALMQS
Solyc05g052410.1.1    (232)  IGQEDLGNFCL--DDEMFDVNELLGMMDSTPVDASAPSQD
Si002067m             (198)  ---------------SVEVLQSEEIVLQKEGNV----------
LOC_Os01g07120.1      (196)  ---------------NMEVCESEGIVLHKEVNI----------
Bradi2g04000.1        (194)  ---------------TAEVFQQEGNALHKEVKV----------
POPTR_0008s07360.1    (228)  ---------------WDEIFSVEELLGDIDSGM----------
POPTR_0010s19100.1    (230)  ---------------MDEIFSFDELLGGIDAGM----------
Glyma12g32400.1       (212)  ---------------AEDDVDMEPISLSLTVKH----------
Glyma13g38030.1       (214)  ---------------AEEDVDMEPISLSLSVKH----------
Glyma06g45680.1       (208)  ---------------AAEDDDMEDLSLSLSVKR----------
Glyma12g11150.1       (210)  ---------------AAEDDGMEDLSLSLSVKH----------
Glyma07g19220.1       (220)  ---------------NGGDVAIAEELEVNHRRC----------
Glyma18g43750.1       (222)  ---------------KHTEEVISEILGLCQGKC----------
AT2G40340.1           (216)  ---------------VDETFDINELLGILNDNN----------
G1755_P4407           (192)  ---------------VHVRIQMQDLVLVRSD----------
AT2G40350.1           (218)  ---------------VHVRIQMQDLVLVRSD----------
```

Fig. 17K

| | | |
|---|---|---|
| Bradi2g29960.1 | (200) | VEAAEPMVENSWTGFQDVGANTVVDFDQQEPSYL------ |
| Si022619m | (202) | ------------------QNEGGAGAGMEQPFYF------ |
| Si022621m | (204) | ------------------QNEGGAGAGMEQPFYF------ |
| Eucgr.G03094.1 | (206) | ---------------------------------------- |
| Solyc06g050520.1.1 | (234) | --------------VFTKDYNSDGKHNNMVSDS-------- |
| Glyma02g42960.1 | (224) | LDFGQMGFPGDGNPQVDDTPSSFIYQLQNPDAKL------ |
| Glyma14g06080.1 | (226) | LDFGQMGFPGDGNPQVDDTLSSFIYQLQNPDAKL------ |
| Solyc05g052410.1.1 | (232) | VGFVPPKQEQYAYDPSYQLHSAAYDANQLSNPAYQLDNAD |
| Si002067m | (198) | --------------------------------SY------ |
| LOC_Os01g07120.1 | (196) | --------------------------------SY------ |
| Bradi2g04000.1 | (194) | --------------------------------SY------ |
| POPTR_0008s07360.1 | (228) | ---------------------------------------- |
| POPTR_0010s19100.1 | (230) | ---------------------------------------- |
| Glyma12g32400.1 | (212) | ---------------------------------------- |
| Glyma13g38030.1 | (214) | ---------------------------------------- |
| Glyma06g45680.1 | (208) | ---------------------------------------- |
| Glyma12g11150.1 | (210) | ---------------------------------------- |
| Glyma07g19220.1 | (220) | ---------------------------------------- |
| Glyma18g43750.1 | (222) | ----------LKISHGDSNHPSMQGIHLFGGGTV------ |
| AT2G40340.1 | (216) | ------VSGQETMQYQVDRHPNFSYQTQFPNSNL------ |
| G1755_P4407 | (192) | ---------------------------------------- |
| AT2G40350.1 | (218) | ---------------------------------------- |

Fig. 17L

```
Bradi2g29960.1      (200)  -------------------DDFNPSMLEGMLQLAEPFPTCI
Si022619m           (202)  -------------------DGLDSSLLESMLQSE-PEPYSL
Si022621m           (204)  -------------------DGLDSSLLESMLQSE-PEPYSL
Eucgr.G03094.1      (206)  ----------------------------------------
Solyc06g050520.1.1  (234)  -------------------QCQEPNAVVDPMTVDYGFDFLK
Glyma02g42960.1     (224)  -------------------LGSLPHMEQTPSGVDYGLDFLK
Glyma14g06080.1     (226)  -------------------LGSLPHMEQTPSGFDYGLDFLK
Solyc05g052410.1.1  (232)  DQFSNPLYQLDNAGVDTLEGLQQMEQQSPIEVDYDFDFLR
Si002067m           (198)  -------------------DYFNVEEVVEMIIELNAD-KK
LOC_Os01g07120.1    (196)  -------------------DYFNVHEVVEMIIVELSAD-QK
Bradi2g04000.1      (194)  -------------------DYFNVEEVLDMIIVELSAD-RK
POPTR_0008s07360.1  (228)  ----------------------------------------
POPTR_0010s19100.1  (230)  ----------------------------------------
Glyma12g32400.1     (212)  ----------------------------------------
Glyma13g38030.1     (214)  ----------------------------------------
Glyma06g45680.1     (208)  --------------------------------------VK
Glyma12g11150.1     (210)  ----------------------------------------
Glyma07g19220.1     (220)  ----------------------------------------
Glyma18g43750.1     (222)  -------------------GPIESMSQLHKLGGYLPEHWNS
AT2G40340.1         (216)  -------------------LGSLNPMEIAQPGVDYGCPYVQ
G1755_P4407         (192)  ----------------------------------------
AT2G40350.1         (218)  ----------------------------------------
```

Fig. 17M

```
Bradi2g29960.1      (200)  SEDRVMPNPGLRDADLSEFFEGL---------------
Si022619m           (202)  SEEQDMFLAGFESPGFFEGL------------------
Si022621m           (204)  SEEQDMFLAGFESPGFFEGL------------------
Eucgr.G03094.1      (206)  ---------KFSSDVKMEH-------------------
Solyc06g050520.1.1  (234)  PGRQEDLNFSSDDLAFIDLDSELVV-------------
Glyma02g42960.1     (224)  TVEPGDYNGGGEEPPFLNLDDDLNHDSNGMQARKGG
Glyma14g06080.1     (226)  TVESGDYNGGGEEPRFLNLDDDLNPDSKGMQARKDD
Solyc05g052410.1.1  (232)  PGRQEDFHFCLDELDVLDF-------------------
Si002067m           (198)  IEVHEECLGGDDGFSLPAY-------------------
LOC_Os01g07120.1    (196)  TEVHEEYQEGDDGFSLPSY-------------------
Bradi2g04000.1      (194)  MEVHEEYQDGDDGFSLPSY-------------------
POPTR_0008s07360.1  (228)  ---------TGAEGYFSLGF------------------
POPTR_0010s19100.1  (230)  ---------MGAEGYFNLGF------------------
Glyma12g32400.1     (212)  -ENGEGESGISSSPPSP---------------------
Glyma13g38030.1     (214)  -ENGEGESGISSSPPSSS--------------------
Glyma06g45680.1     (208)  HEEGEDESGTSSSYLSLS--------------------
Glyma12g11150.1     (210)  -EEGEDESGTSSSYLSLS--------------------
Glyma07g19220.1     (220)  ---------HEDRPRFSK--------------------
Glyma18g43750.1     (222)  VQFPDLEVGHDYSFLNPDYDFGLYEEQKLLDICFPH
AT2G40340.1         (216)  PSDMENYGIDLDHRRFNDLDIQDLDFGGDKDVHGST
G1755_P4407         (192)  --------------------------------------
AT2G40350.1         (218)  --------------------------------------
```

Fig. 17N

```
AT1G28160.1           (246) ---------------------------------MEFNGN
GRMZM2G047999_T01     (236) MQQQPLSLRLSALASTTATNNSLYSFSVCVLLCSCMDFS
LOC_Os02g32040.1      (238) -----------------------------------MDFY
LOC_Os04g32790.1      (240) ----------------------------------MMNFSSY
GRMZM2G023708_T01     (242) -----------------------------------MNFSSY
GRMZM2G079825_T01     (244) -----------------------------------MNFSSY
POPTR_0001s12820.1    (250) ------------------------------------MDFTYS
POPTR_0003s15940.1    (252) ------------------------------------MDFTQS
Eucgr.I01576.1        (260) ---------------------------------------
Glyma16g05070.1       (268) ---------------------------------------
Glyma02g07460.1       (262) --------------------------------------M
Glyma16g26460.1       (264) --------------------------------------M
Eucgr.B03565.1        (248) ------------------------------MDHLNFTVS
AT5G13910.1           (254) ---------------------------------------
GSVIVT01032961001     (266) ---------------------------------------
POPTR_0001s15710.1    (256) ---------------------------------------
POPTR_0003s07540.1    (258) ---------------------------------------
```

Fig. 19A

```
AT1G28160.1         (246) LNAGS---------------CSRKKSHRQKQQQP----Q
GRMZM2G047999_T01   (236) YLFSS---------------SSSEKKSSKRLQQQQ----LL
LOC_Os02g32040.1    (238) FFSSS---------------APAPEKKTRRQQQQQ--QQRE
LOC_Os04g32790.1    (240) FYSSSAAAAGGGGGGEKKSSSSSASKKKQQQAA------
GRMZM2G023708_T01   (242) FFSSS--------SSSSDKKSSSSSSKRRQQAAQ------
GRMZM2G079825_T01   (244) FFSSS---------------SSDKKSSSKRQQQQA------
POPTR_0001s12820.1  (250) TKTNS---------------SPSPSKTKRKQQQQQ------
POPTR_0003s15940.1  (252) TKTNS---------------TPSPSKNKRKQQQQQ---QK
Eucgr.I01576.1      (260) --MSS---------------PSSSSKGNKKQPPAG------
Glyma16g05070.1     (268) ----E---------------SPHQ-----------------
Glyma02g07460.1     (262) KPYTS---------------SPSSSRSKKKQTTTQ------
Glyma16g26460.1     (264) KPYTS---------------SPSSSKSKKKPTTTQ------
Eucgr.B03565.1      (248) SSPVN---------------SPSPSKAKRKHQQQQTPPPLQ
AT5G13910.1         (254) ----M---------------NTTSSKSKKKQDDQV------
GSVIVT01032961001   (266) ----M---------------NPSTSKSKKKQTQQQ------
POPTR_0001s15710.1  (256) ----M---------------NPSSSNRKKKQPQQV------
POPTR_0003s07540.1  (258) ----M---------------NPSSSKSKRKQPQQV------
```

Fig. 19B

```
AT1G28160.1        (246) PQPQQHIEEIKYVGVRRRPWGRYAAEIRNPTTKERYWLGT
GRMZM2G047999_T01  (236) QQQDNNSNETRYLGVRRRPWGRYAAEIRDPATKERHWLGT
LOC_Os02g32040.1   (238) QEGGGGNEARYLGVRRRPWGRYAAEIRDPATKERHWLGT
LOC_Os04g32790.1   (240) -AAEGGNNQTRYLGVRRRPWGRYAAEIRDPATKERHWLGT
GRMZM2G023708_T01  (242) --PQPDANTTRYLGVRRRPWGRYAAEIRDPATKERHWLGT
GRMZM2G079825_T01  (244) AQPQTDANTTRYLGVRRRPWGRYAAEIRDPATKERHWLGT
POPTR_0001s12820.1 (250) QQNQQEQQEVRFLGVRRRPWGRYAAEIRDPSTKERHWLGT
POPTR_0003s15940.1 (252) NQNQQEQHEVRFLGVRRRPWGRYAAEIRDPSTKERHWLGT
Eucgr.I01576.1     (260) --ESSAAGGGRFLGVRRRPWGRYAAEIRDPSTKERHWLGT
Glyma16g05070.1    (268) --RASSSWGGRYLGVRRRPWGRYAAEIRDPSTKERHWLGT
Glyma02g07460.1    (262) -QDHETAWGGRYLGVRRRPWGRYAAEIRDPSTKERHWLGT
Glyma16g26460.1    (264) -QDHETAWGGRYLGVRRRPWGRYAAEIRDPSTKERHWLGT
Eucgr.B03565.1     (248) THQDDGAAPARFLGVRRRPWGRYAAEIRDPTTKERHWLGT
AT5G13910.1        (254) --------GTRFLGVRRRPWGRYAAEIRDPTTKERHWLGT
GSVIVT01032961001  (266) ------ETSGRFLGVRRRPWGRYAAEIRDPSTKERHWLGT
POPTR_0001s15710.1 (256) --QQEPGTGLRFLGVRRRPWGRYAAEIRDPSTKERHWLGT
POPTR_0003s07540.1 (258) --QQEPGTGLRFLGVRRRPWGRYAAEIRDPSTKERHWLGT
consensus          (853)          XXXGVRRRPWGRYAAEIRXPXTKERXWLGT
```

Fig. 19C

| | | |
|---|---|---|
| AT1G28160.1 | (246) | FDTAEEAALAYDRAARSIRGLTARTNFVYSDMPRGSSVTS |
| GRMZM2G047999_T01 | (236) | FDTAEEAAIAYDRAARNIRGANARTNFAYPDLPPGSSVTP |
| LOC_Os02g32040.1 | (238) | FDTAEEAAVAYDRAARTIRGAAARTNFAYPDLPPGSSLIP |
| LOC_Os04g32790.1 | (240) | FDTAEEAAVAYDRAARSLRGARARTNFAYPDLPPGSSVTP |
| GRMZM2G023708_T01 | (242) | FDTAEEAAVAYDRAARSLRGARARTNFAYPDLPPGSSVTP |
| GRMZM2G079825_T01 | (244) | FDTAEEAAVAYDRAARSLRGARARTNFAYPDLPPGSSVTP |
| POPTR_0001s12820.1 | (250) | FDTAEEAALAYDRAARSMGSKARTNFVYSDMPPASSVTC |
| POPTR_0003s15940.1 | (252) | FDTAEEAALAYDRAARSMGSKARTNFVYSDMPPASSVTS |
| Eucgr.I01576.1 | (260) | FDTAEEAALAYDRAARSMGSRARTNFVYSDLPAGSSVTS |
| Glyma16g05070.1 | (268) | FDTADEAALAYDRAARAMGSRARTNFVYADTTPGSSVTP |
| Glyma02g07460.1 | (262) | FDTAEEAALAYDRAARSMRGSRARTNFVYPDTPPGSSVTS |
| Glyma16g26460.1 | (264) | FDTAEEAALAYDKAARSMRGSRARTNFIYPDTPPGSSVTS |
| Eucgr.B03565.1 | (248) | FDTAEEAALAYDRAARSMRGAKARTNFVYSDMPPGSSVTS |
| AT5G13910.1 | (254) | FDTAEEAALAYDRAARSMRGTRARTNFVYSDMPPSSSVTS |
| GSVIVT01032961001 | (266) | FDTAEEAALAYDRAARSMRGSRARTNFVYSDMPPGSSVTS |
| POPTR_0001s15710.1 | (256) | FDTAEEAALAYDRAARSMRGSRARTNFVYSDMPAGSFVTS |
| POPTR_0003s07540.1 | (258) | FDTAEEAALAYDRAARSMRGPRARTNFVYSDMPAGSSVTS |
| consensus | (853) | FDTAXEAAXAYDXAARXXRGXXARTNFXYXDXXX |

Fig. 19D

```
AT1G28160.1         (246) FVSPDESQR------------------FISELFN---P
GRMZM2G047999_T01   (236) YLSPDLSAD------------------QLQHYYYANNDP
LOC_Os02g32040.1    (238) YLSPDLSTN------------------DLHRHYYGAGA
LOC_Os04g32790.1    (240) YLSPDLSAD--------------ASDQLLQPFYAN--P
GRMZM2G023708_T01   (242) YLSPDLTSG--------------DNATQLLQPFYA---D
GRMZM2G079825_T01   (244) YLSPDLTSG--------------DNATQLLQPFYAA--D
POPTR_0001s12820.1  (250) IISPDESQHDNSALFAPPPQHNTHQNDTNCQQLYFSQDQQ
POPTR_0003s15940.1  (252) IISPDESQHDISALFAPPPQNHAHQNDTNCQKLFFSQDQY
Eucgr.I01576.1      (260) ILSPDEAQQ------------------QNFSPIFANSAP
Glyma16g05070.1     (268) IISPDQPQP-----------------------------D
Glyma02g07460.1     (262) ILSPDEQTQ-------------TQIHQAQEELSSLF----N
Glyma16g26460.1     (264) ILSPDEQTQ-------------TQIHQAQEELSSLF----N
Eucgr.B03565.1      (248) LVSPDEAHSDFAALFISQHHHQQQEQPHHHHHGKSSNNPN
AT5G13910.1         (254) IVSPDDPPP-----------------------------P
GSVIVT01032961001   (266) IISPDESLP------------------DFSSHF------
POPTR_0001s15710.1  (256) IISPDEQQS------LQQQQHQQHSDNNNNLSSLFINV-P
POPTR_0003s07540.1  (258) IISPDDQQS------LQQQLQQNSDHNSNLSSLFFNARP
```

Fig. 19E

```
AT1G28160.1          (246) PSQLEATNSNNNNNNNLYSSTNNQNQNSIEF--------------
GRMZM2G047999_T01    (236) VAPAADQPPTPACDQSAHGGAAGTEAY-------------------
LOC_Os02g32040.1     (238) GADTQTAAALPAPAQPAHGGDAQEM---------------------
LOC_Os04g32790.1     (240) SAAAALPTPAAV--MAGGGGVEFGGEYMYGGGVDMSSLMD
GRMZM2G023708_T01    (242) PAASLAAAAPAATNGAAGYGAAGDYASY------------
GRMZM2G079825_T01    (244) AAAASLPPALPAANGAAGYGAAAGDYASY-----------
POPTR_0001s12820.1   (250) PFNAHAYGNSNSNWLAGGAGWVQGFGAGAGD---------
POPTR_0003s15940.1   (252) PFNAYAYGNSNSNLLTGGEGWVQGCGAGAAD---------
Eucgr.I01576.1       (260) -----RPDPAPQLDAGGYAESAWSTSAYY-----------
Glyma16g05070.1      (268) PVLSFDPFSLLAFPSGSYSASVAASQFS------------
Glyma02g07460.1      (262) PNPFAQPDPNPHFSLCGYSGVTNTPTFSATEEIAPSGGYS
Glyma16g26460.1      (264) PNPFPQPDPNPQFSLCGFSGIPNTPTFSATEEIASSGGYS
Eucgr.B03565.1       (248) HQLFYTPGSMSACNVDFTSGLPAENGWAAD----------
AT5G13910.1          (254) PPPPAPPSNDPVDYMMMFNQYSSTDSPMLQ----------
GSVIVT01032961001    (266) ----------PLVDNMNGTTTTTNNQFY------------
POPTR_0001s15710.1   (256) PSHDHQPDSTPIFNQDFSSQCHLEEGFS------------
POPTR_0003s07540.1   (258) PSHDLQPDSTPIFNQDFTSQCHLSDGFS------------
```

Fig. 19F

```
AT1G28160.1         (246)  ---SYNGWPQEAECGYQSITSNAEH-----CDHELP-PLP
GRMZM2G047999_T01   (236)  ---QYYHHVPVEMMSSYGAAEGASVM----DYGGNP-EMG
LOC_Os02g32040.1    (238)  ---AYGGGGGQNVGGVFDVV--------------------
LOC_Os04g32790.1    (240)  DIAAMPDDLPPSVTGGGGGPASSDEYSS--GGGGMV-DDV
GRMZM2G023708_T01   (242)  ---GYSAEDMSALMEDLAIPDDLTADYGAEDAGGGSVNMP
GRMZM2G079825_T01   (244)  ---GYSAEDMSALMDDLTIPDDLTADYGAEDAGGSV-DMS
POPTR_0001s12820.1  (250)  ---GPCGSYEPNSAGSLDVASGLNYLSNT-DNIELP-PLP
POPTR_0003s15940.1  (252)  ---GPGGSYEPNNAGSFGVATEPIYFSNK-DNIELP-PLP
Eucgr.I01576.1      (260)  ---SQQADAAPYGGGGGGAYSQCHY-----DNVELP-PLP
Glyma16g05070.1     (268)  -----QQQQQPDNNNNNNIINNSNNNKD--STIELP-PLP
Glyma02g07460.1     (262)  YNYGYTEGGTSMESSHFKLFDD--------GETELP-PLP
Glyma16g26460.1     (264)  YSYGYTEGGTGVESSHFKLFDD--------GETQLP-PLP
Eucgr.B03565.1      (248)  ---GYLGGGPYHPATSIADFGDAARPQSY-DEAELP-PFP
AT5G13910.1         (254)  ---PHCDQVDSYMFGGSQSSNSYCYSND--SSNELP-PLP
GSVIVT01032961001   (266)  ------------------------------NANDLP-PFP
POPTR_0001s15710.1  (256)  ---SMTSGGGFWSCSSNNTYNQQLKHVI--QNNVLPHDFP
POPTR_0003s07540.1  (258)  ---SMTSGGDSWCCSSTRTDNQQLQHVN--DYNVLPHEFP
```

Fig. 19G

```
AT1G28160.1         (246) PSTCF----GAELRIPETDSY-W------------------
GRMZM2G047999_T01   (236) MYFEGN---GSGGDD---DRA-WCEASSELLFGGYSD---
LOC_Os02g32040.1    (238) ---------GGGG------GAA-WCDASELEFGGYDD---
LOC_Os04g32790.1    (240) SMYCG----GNGG------GSS-WCDASD--FASYSSS---
GRMZM2G023708_T01   (242) SMYSG----GGGANAS--SGSGWCDASEFSAYG-------
GRMZM2G079825_T01   (244) SMYGGGGSSANASSASSGGGG-WCDASE------------
POPTR_0001s12820.1  (250) PDVNSS---CYGCDMG--REF-WNDT---GFLGFQEE---
POPTR_0003s15940.1  (252) PDVNSS---CYGSDMD--HGF-WNDA---GFFGFQEE---
Eucgr.I01576.1      (260) SDMSG----YSGYSGSDTSSYSYGDTVPSNCYS-------
Glyma16g05070.1     (268) PDITS----SVGY------EGF-YNND-------------
Glyma02g07460.1     (262) PDITS----SMGYEMG--NGF-------------------
Glyma16g26460.1     (264) PDITS----SMGYEMS--NGL-YGND-----VGFSD----
Eucgr.B03565.1      (248) PDLSSCY--GSGLDMG--HGG-WTDM-----GFLGL----
AT5G13910.1         (254) SDLS-----NSCYSQP--QWT-WTGDDY------------
GSVIVT01032961001   (266) SQVSDQLP-SSGFEME--QAT-WGDSTS--LAGFSEQRTS
POPTR_0001s15710.1  (256) SNISH----SSDYNMS--QCS-WTDSSTSGLMGFEDQTTM
POPTR_0003s07540.1  (258) SDISH----DSGYSMG--QCG-LTDSSSRLMGFEDQTAM
```

Fig. 19H

| | | |
|---|---|---|
| AT1G28160.1 | (246) | -----NVAHASIDTFAFEL-DGFVDQNSLGQ--------- |
| GRMZM2G047999_T01 | (236) | DAAAAPANASHGMYF---E-EGYV-HSPMFSPMPAADE-- |
| LOC_Os02g32040.1 | (238) | ---AGASAAAAVYF---E-EGYV-HSPMFSPMPAADE-- |
| LOC_Os04g32790.1 | (240) | SPAAAAAAGSHGMYF---E-EGYV-HSPLFSPMPAVDD-- |
| GRMZM2G023708_T01 | (242) | ---APTIAASHGVYF---E-EGYV-HSPLFSPMPAVDD-- |
| GRMZM2G079825_T01 | (244) | FSAYGASAASHGVYF---E-EGYV-HSPLFSPMPAVDD-- |
| POPTR_0001s12820.1 | (250) | QLDDVNGLEVSGSILGFDS-NEFGLHGSLFGIVPSVSN-- |
| POPTR_0003s15940.1 | (252) | QKNNGNGLEISGSSLGFDS-NDFGQHGSLFEIMPSVSD-- |
| Eucgr.I01576.1 | (260) | DFHDPAAASGNGPSFGFDSTEEYV-HSPLFSRMPPVSD-- |
| Glyma16g05070.1 | (268) | -----------GGYYWEED-DNYL-HNPMFSTMPAX---- |
| Glyma02g07460.1 | (262) | ---GANATGSGYPYSGFGS-GDYVVHSPLFSAMPPVSDNV |
| Glyma16g26460.1 | (264) | PSCGANASGSGYPYSGFES-GDYVVHSPLFSAMPSVSDNV |
| Eucgr.B03565.1 | (248) | QEQSIVPGPSNGLNMGFDP-NELVEHGPLFGRMPQVSD-- |
| AT5G13910.1 | (254) | -----------------S-SEYV-HSPMFSRMPPVSD-- |
| GSVIVT01032961001 | (266) | PNEFDSAGG--GSYLGFDS-TQYV-HSPLFGRMPPVSD-- |
| POPTR_0001s15710.1 | (256) | TSGFESVGSSSGSYFGFDS-GEYV-HSPLFSRMPPVSD-- |
| POPTR_0003s07540.1 | (258) | TTGFDSVGGGSGSYFGFDS-GEYV-HSPLFSRMPPVSD-- |

Fig. 19I

| | | |
|---|---|---|
| AT1G28160.1 | (246) | -SGTEGPNSL---PSTFFYQ |
| GRMZM2G047999_T01 | (236) | ---VDGPQLGGPSSSSYYY- |
| LOC_Os02g32040.1 | (238) | -VAADGPQLGGSSSSSYYY- |
| LOC_Os04g32790.1 | (240) | -AGADGPQLGG-SSSSYYY- |
| GRMZM2G023708_T01 | (242) | -ASADGPQLGG-SSSSYYY- |
| GRMZM2G079825_T01 | (244) | -ACADGPQLGG-SSSSYYY- |
| POPTR_0001s12820.1 | (250) | -TVTDGPDLG--SSSTFYF- |
| POPTR_0003s15940.1 | (252) | -TVTDELDLG--SSSTLYF- |
| Eucgr.I01576.1 | (260) | -SVPDSFNLG----GSYFF- |
| Glyma16g05070.1 | (268) | -------------------- |
| Glyma02g07460.1 | (262) | STGHEGPDLA---SSSFFF- |
| Glyma16g26460.1 | (264) | ATGHEGPDLG---SSSYFF- |
| Eucgr.B03565.1 | (248) | -KGVDGPDLG--SSSAYYF- |
| AT5G13910.1 | (254) | -SFPQGFN--------YFGS |
| GSVIVT01032961001 | (266) | -TPPDGPDLG---SSSYFF- |
| POPTR_0001s15710.1 | (256) | -MVPDGPDLG---SSAYFF- |
| POPTR_0003s07540.1 | (258) | -MAPDGPDLS---SSAYFF- |

Fig. 19J

```
Bradi4g35950.1        (270) MRTICDVCESAVAVLFCAADEAALCRSCDEKVHLCNKLAS
LOC_Os09g35880.1      (272) MRTICDVCESAPAVLFCVADEAALCRSCDEKVHMCNKLAR
GRMZM2G143718_T01     (274) MRTICDVCESAPAVLFCAADEAALCRPCDEKVHMCNKLAS
GRMZM2G422644_T01     (276) MRTICDVCESAPAVLFCAADEAALCRPCDEKVHMCNKLAS
AT2G21320.1           (278) MRILCDACESAAAIVFCAADEAALCCSCDEKVHKCNKLAS
Solyc01g110370.2.1    (302) MRTLCDVCESAAAILFCAADEAALCRSCDEKVHLCNKLAS
Eucgr.I01328.1        (294) MRTLCDVCENAAAIFFCAADEAALCRACDEKVHLCNKLAS
Eucgr.I02368.1        (282) MRTLCDACESAAAVVFCAADEAALCSACDDKVHMCNKLAS
GSVIVT01024173001     (300) MRTLCDACESAAAILFCAADEAALCRACDEKVHMCNKLAS
POPTR_0004s16950.1    (296) MRMLCDVCESAAAILFCAADEAALCRSCDEKVHMCNKLAS
POPTR_0009s12730.1    (298) MRTLCDVCESAAAILFCAADEAALCRSCDEKVHLCNKLAS
POPTR_0005s11900.1    (288) MRTLCDACESAFAIVFCAADEAALCLACDKKVHMCNKLAS
POPTR_0007s13830.1    (290) MRTLCDACESAAAIVFCAADEAALCLACDEKVHMCNKLAS
Glyma01g37370.1       (284) MRTLCDACESAAAIVFCAADEAALCRACDEKVHMCNKLAS
Glyma11g07930.1       (286) MRTLCDACESAAAIVFCAADEAALCRACDEKVHMCNKLAS
GSVIVT01018818001     (292) MRTLCDVCESAAAILFCAADEAALCRVCDEKVHMCNKLAS
Glyma11g11850.1       (304) MRTLCDVCESAAAILFCAADEAALCSACDHKIHMCNKLAS
Glyma12g04130.1       (306) MRTLCDVCESAAAIVFCAADEAALCSACDHKIHMCNKLAS
consensus             (854)      CDXCEXAXAXXFCXADEAALCXXCDXKXHXCNKLAX
```

Fig. 23A

| | | | |
|---|---|---|---|
| Bradi4g35950.1 | (270) | RHVRVGLADPNKLVR | CDICENSPAFFYCDIDGTSLCLSCD |
| LOC_Os09g35880.1 | (272) | RHVRVGLADPNKVQR | CDICENAPAFFYCEIDGTSLCLSCD |
| GRMZM2G143718_T01 | (274) | RHVRVGLADPNKLVR | CDICENSPAFFYCEIDGTSLCLSCD |
| GRMZM2G422644_T01 | (276) | RHVRVGLADPNKLAR | CDICENSPAFFYCEIDGTSLCLSCD |
| AT2G21320.1 | (278) | RHLRVGLADPSNAPS | CDICENAPAFFYCEIDGSSLCLQCD |
| Solyc01g110370.2.1 | (302) | RHVRVGLADPSKIQR | CDICENAPAFFYCEIDGSSLCLQCD |
| Eucgr.I01328.1 | (294) | RHVRVGLADPSEVQR | CDICENAPAFFYCEIDGSSLCLQCD |
| Eucgr.I02368.1 | (282) | RHVRVGLASPSDVPR | CDICENAPAFFYCEVDGTSLCLQCD |
| GSVIVT01024173001 | (300) | RHVRVGLADPSDVPR | CDICENAPAFFYCEVDGTSLCLQCD |
| POPTR_0004s16950.1 | (296) | RHVRVGLADPSDVPQ | CDICEKAPAFFYCEIDGSSLCLQCD |
| POPTR_0009s12730.1 | (298) | RHVRVGLADPSAVPQ | CDICENAPAFFYCEIDGSSLCLQCD |
| POPTR_0005s11900.1 | (288) | RHVRVGLANPSEVPR | CDICENAPAFFYCETDGSSLCLQCD |
| POPTR_0007s13830.1 | (290) | RHVRVGLANPSDVPR | CDICENAPAFFYCETDGSSLCLQCD |
| Glyma01g37370.1 | (284) | RHVRVGLASPSDVPR | CDICENAPAFFYCETDGSSLCLQCD |
| Glyma11g07930.1 | (286) | RHVRVGLASPSDVPR | CDICENAPAFFYCETDGSSLCLQCD |
| GSVIVT01018818001 | (292) | RHVRVGLADPSDVPR | CDICENAPAFFYCEIDGTSLCLQCD |
| Glyma11g11850.1 | (304) | RHVRVGLADPTDVPR | CDICENAPAFFYCEIDGSSLCLQCD |
| Glyma12g04130.1 | (306) | RHVRVGLADPTDVPR | CDICENAPAFFYCEIDGSSLCLQCD |
| consensus | (854, 855) | RH | CDICEXXPAFFYCXXDGXSLCLXCD |

Fig. 23B

| | | |
|---|---|---|
| Bradi4g35950.1 | (270) | MAVHVGGKRTHGRYLLLRQRVEFPGDKPGNMDDVPMQQIE |
| LOC_Os09g35880.1 | (272) | MTVHVGGKRTHGRYLLLRQRVEFPGDKPGHMDDVAMQQKD |
| GRMZM2G143718_T01 | (274) | MTVHVGGKRTHGRYLLLRQRVEFPGDKPGHMDDVPMEIQD |
| GRMZM2G422644_T01 | (276) | MTVHVGGKRTHGRYLLLRQRVEFPGDKPGHMDDVPMEIKD |
| AT2G21320.1 | (278) | MVVHVGGKRTHRRFLLLRQRIEFPGDKPNHADQLGLRCQK |
| Solyc01g110370.2.1 | (302) | MTVHVGGKRTHGRYLLIRQRIEFPGDKLGPSNEQGLPSTE |
| Eucgr.I01328.1 | (294) | MLVHVGGKRTHGRYLLLRQRVEFPGDKPGRLES---QTPN |
| Eucgr.I02368.1 | (282) | MIVHVGGKRTHGRYLLLRQRVEFPGHKSAHSDDQALPLVD |
| GSVIVT01024173001 | (300) | MIVHVGGKRTHGRYLLLRQRVEFPGDKPGRLEELRLQSGE |
| POPTR_0004s16950.1 | (296) | MIVHVGGKRTHGRYLLLRQRVEFPGDKPGCTEEQGQQPLD |
| POPTR_0009s12730.1 | (298) | MIVHVGGKRTHGRYLLLRQRVEFPGDKPGRMEEQGQQPLD |
| POPTR_0005s11900.1 | (288) | MTVHVGGKRTHGRYLLLRQKIEFPGNQP-QPEDPAPQPMY |
| POPTR_0007s13830.1 | (290) | MTVHVGGKRTHGRYLLLRQRVEFPGDKP-QPDDLHSQPMH |
| Glyma01g37370.1 | (284) | MIVHVGGKRTHGRYLLFRQRVEFPGDKSSHAENPASQPLE |
| Glyma11g07930.1 | (286) | MIVHVGGKRTHGRYLLFRQRVEFPGDKSSHAENPASQALE |
| GSVIVT01018818001 | (292) | MTVHVGGKRTHGRYLLLRQRVEFPGDKSGNLEDPALLPME |
| Glyma11g11850.1 | (304) | MIVHVGGKRTHGRYLLLRQAQFPGDKPAQMEELELQPMD |
| Glyma12g04130.1 | (306) | MIVHVGGKRTHGRYLLLRQRVQFP--------------- |
| consensus | (855) | MXVHVGGKRTH |

Fig. 23C

```
Bradi4g35950.1      (270)  S-ENQRDQNKAPHSVPKEQMVSHHHAY-DNHASDGNCNGQ
LOC_Os09g35880.1    (272)  P-ENRTDQKKAPHSVTKEQMANHHNVS-DDPASDGNCDDQ
GRMZM2G143718_T01   (274)  P-ENQRDQKKPPK-----EQTANHHNGD--DPAIDGNCDDQ
GRMZM2G422644_T01   (276)  P-ENQREQNTP------KEQMANHHNVN--DPVSDGNCDGQ
AT2G21320.1         (278)  ASSGR-------------------------GQESNGN
Solyc01g110370.2.1  (302)  QGDVRRETAQPFKLPMIDNHQPNRETA--MTAVENNVNNS
Eucgr.I01328.1      (294)  QNEVKREKDQPHKLAMKEVQQNHRASP--VPVGDAISSGE
Eucgr.I02368.1      (282)  Q-NDKRVQNQGPIVISGENHQNHRPSSVEVPDADADADGH
GSVIVT01024173001   (300)  PGEARREQNWPPMMTLRETQPNHMASS--VPMLENNTHGD
POPTR_0004s16950.1  (296)  DNETRRDQNQPPKLTARENQQNHRASP--VPMVENNTDSD
POPTR_0009s12730.1  (298)  HNETRRDQNQPLKLTARENKQNHRASP--VPMVENNTDSD
POPTR_0005s11900.1  (288)  PGETRRGQNRPQKATSGENRQNRQASP--VLMSVTNSDGH
POPTR_0007s13830.1  (290)  PGETRKGQNQPPKATAEEKRQNRQVSP--APMSLSNSDGH
Glyma01g37370.1     (284)  PGEAKRGQNPLPKLKMGEKQQNHKMPM--VPTPGPDADGH
Glyma11g07930.1     (286)  PGEAKRGQNPLPKLKMGEKQQNHRMPM--VPTPGPDADGQ
GSVIVT01018818001   (292)  PGENRRGQNQSSKPTVVENQQNRRVSP--VPTMDANADGH
Glyma11g11850.1     (304)  QNESRRDESQSLKLKTRDSQQNHSVSP--FPRQENNIDGH
Glyma12g04130.1     (306)  ----------------YSQQNHSVSP--VPRQENNIDGH
```

Fig. 23D

```
Bradi4g35950.1      (270) GNIDSKMEDLNMRPARN-HGQGSSSQTQAVDH-SANNHDS
LOC_Os09g35880.1    (272) GNIDSKMIDLNMRPVRT-HGQGSNSQTQGVDV-SVNNHDS
GRMZM2G143718_T01   (274) GNIDSKMIDLNMRPVRT-HGQESNSQTQGVGL-SVNNHDS
GRMZM2G422644_T01   (276) GNIDSKMIDLNMRPART-HGQGSNSQTQGVDL-SVNNHDS
AT2G21320.1         (278) GDHDHNMIDLNSNPQRV-HEPGSHNQEEGIDVNNANNHEH
Solyc01g110370.2.1  (302) VKVENELIDLNSRPQRM-HGQTSNNQEQVMDLGGSNHES
Eucgr.I01328.1      (294) GKMQDKMIDLNSRPQRT-KGQTSMNED--MDVTNGSNLES
Eucgr.I02368.1      (282) GKMDSKMIDLNMKPHRM-HDQASYNEQ------------
GSVIVT01024173001   (300) GKMDNKLIDLNARPQRV-HGQTSNNQS--MDVHSGTNHES
POPTR_0004s16950.1  (296) GKMDNKLIDLNARPQRV-HGKNPTNQE---------NHES
POPTR_0009s12730.1  (298) GKMDNNLIDLNARPQRI-HGQNSTNQE---------NHES
POPTR_0005s11900.1  (288) DKVDKNMIDLNMKPHRI-HEHASNNQEQ-----------
POPTR_0007s13830.1  (290) DKVDKKMIDLNMKPQRTDHEQASNNQEL-----------
Glyma01g37370.1     (284) AKMESKMIDLNMKPNRI-HEQASNNQP------------
Glyma11g07930.1     (286) TKMETKMIDLNMKPNRI-HEQASNNQCSWMKV-------
GSVIVT01018818001   (292) AKMDTKLIDLNMKPHRI-HGQASNNQH------------
Glyma11g11850.1     (304) GKMDKKLIDLNTRPLRL-NGSAPNNQEQCMDILRGNNHES
Glyma12g04130.1     (306) GKMDKKLIDLNTRPLRL-NGAAPNNQERGMDILRGNNHKS
```

Fig. 23E

```
Bradi4g35950.1        (270)  SGVVPTCNLERDTNK---------------------------
LOC_Os09g35880.1      (272)  PGVVPTCNFEREANK---------------------------
GRMZM2G143718_T01     (274)  PGVVPTSNSERDTSK---------------------------
GRMZM2G422644_T01     (276)  PGVVPTSNSERDAIK---------------------------
AT2G21320.1           (278)  E-----------------------------------------
Solyc01g110370.2.1    (302)  VGVVPDGPFKREPEKCELLPFQISNLNYELELPAPAEFYA
Eucgr.I01328.1        (294)  AGVVPVGSFDRQPEMKQST-----------------------
Eucgr.I02368.1        (282)  ------------------------------------------
GSVIVT01024173001     (300)  ESVVPVGSFKREPEK---------------------------
POPTR_0004s16950.1    (296)  SSLAPFGFFKGEPQK---------------------------
POPTR_0009s12730.1    (298)  SSAVPVGSFKREPQK---------------------------
POPTR_0005s11900.1    (288)  ------------------------------------------
POPTR_0007s13830.1    (290)  ------------------------------------------
Glyma01g37370.1       (284)  ------------------------------------------
Glyma11g07930.1       (286)  -----------EPFP---------------------------
GSVIVT01018818001     (292)  ------------------------------------------
Glyma11g11850.1       (304)  ASVPPVESFKQESEK---------------------------
Glyma12g04130.1       (306)  ASVPPVESFKQESEK---------------------------
```

Fig. 23F

| | | |
|---|---|---|
| Bradi4g35950.1 | (270) | ---- |
| LOC_Os09g35880.1 | (272) | ---- |
| GRMZM2G143718_T01 | (274) | ---- |
| GRMZM2G422644_T01 | (276) | ---- |
| AT2G21320.1 | (278) | ---- |
| Solyc01g110370.2.1 | (302) | MSKL |
| Eucgr.I01328.1 | (294) | ---- |
| Eucgr.I02368.1 | (282) | ---- |
| GSVIVT01024173001 | (300) | ---- |
| POPTR_0004s16950.1 | (296) | ---- |
| POPTR_0009s12730.1 | (298) | ---- |
| POPTR_0005s11900.1 | (288) | ---- |
| POPTR_0007s13830.1 | (290) | ---- |
| Glyma01g37370.1 | (284) | ---- |
| Glyma11g07930.1 | (286) | ---- |
| GSVIVT01018818001 | (292) | ---- |
| Glyma11g11850.1 | (304) | ---- |
| Glyma12g04130.1 | (306) | ---- |

Fig. 23G

```
Bradi1g35990.1         (308)  ----MR-------------------------RPSPP
GRMZM2G074438_T01      (310)  -----------------MRHASP---------PQEL
S1006781m              (314)  -----------------MRHRLP---------LPPEL
GRMZM2G378653_T01      (312)  MAPLSPTPASASAPVSSSPRSLVPDASAAPMRPASPPQEL
AT2G42300.1            (316)  ----MDLTQGFRARSGVVGPV-----------AGLES
AT3G57800.2            (318)  ----MDLTGGFGARSGGVGPCREP--------IGLES
Solyc10g079070.1.1     (336)  MDNLIECIEAGEARSENCGARMGE--------IKDGF
Eucgr.A02413.1         (320)  ----MEP----SSLTLAGSTD-----------AALES
Glyma10g12210.1        (326)  ----MEQ-------------------------TTLEA
Glyma03g29710.1        (322)  ----MDQ----APGGLRGSVHDG---------ATLES
Glyma19g32570.1        (324)  ----MDQ----APGGLRGSVHHG---------ATLES
POPTR_0006s05600.1     (332)  ----MDLTT---ASGARSGPELDE--------TGLDS
GSVIVT01033350001      (334)  ----MERIAGTGGRSGSTGGEKEE--------IGAES
clementine0.9_011877m  (328)  ----MEPTE---HRSSAIGPSLDQ--------NALDS
clementine0.9_015567m  (330)  ----MEPTE---HRSSAIGPSLDQ--------NALDS
```

Fig. 26A

```
Bradi1g35990.1          (308) PAAGGEIQALAV--APAS-----AAGSSSSTTTTGGGGSF
GRMZM2G074438_T01       (310) PAAGREIQAALA--PANG---------NAAGARGGGGSF
Si006781m               (314) PAAGGEIQAALI--PAAAPATGPAVSASSAAGRGGGGSF
GRMZM2G378653_T01       (312) PAAGGEIQAALA--PANA---------STAGARGGGGSF
AT2G42300.1             (316) LNFSDEFRHLVTTMPPET---------------TGGSF
AT3G57800.2             (318) LHLGDEFRQLVTTLPPEN---------------PGGSF
Solyc10g079070.1.1      (336) HQFGEEILSVTS-----E---------------GGSSF
Eucgr.A02413.1          (320) V-LTEEIRSLMA--PPPE---------------STSSF
Glyma10g12210.1         (326) IQFNEEIQGLMAA-PAPE---------------TVNSF
Glyma03g29710.1         (322) IQFNEEIQGIMAPVPAPE---------------NANSF
Glyma19g32570.1         (324) IQFNEEIQGLMA--PAPE---------------NASSF
POPTR_0006s05600.1      (332) FQLGEDIRHLIT--APSE---------------NASSF
GSVIVT01033350001       (334) FLFGEEIQRLMT--GPPE---------------NGSSF
clementine0.9_011877m   (328) LQFNEEIQHLMT--LPPE---------------NANSF
clementine0.9_015567m   (330) LQFNEEIQHLMT--LPPE---------------NANSF
```

Fig. 26B

```
Bradi1g35990.1          (308)  TALLGLPMSQAMELLL------PPSAPPP----------
GRMZM2G074438_T01       (310)  TALLGLPTPQAMELLL------PRTTPPALALAPAAAP--
S1006781m               (314)  TALLGLPTSQAMELLL------PRAAAAPPAPAPAP----
GRMZM2G378653_T01       (312)  TALLGLPTSQAMELLL------PRTTPPALAT--------
AT2G42300.1             (316)  TALLEMPVTQAMELLH------FPDSSSSQARTVTSGDISP
AT3G57800.2             (318)  TALLELPPTQAVELLH------FTDSSSSQQAAVTGIGGEI
Solyc10g079070.1.1      (336)  TALLGLPPNQAVELLV----QSPETDKIA-SDKLAISEPH
Eucgr.A02413.1          (320)  TALLELPRTRAIELLH------SPEAPNSPGVAVPGGPAGT
Glyma10g12210.1         (326)  KALLELPSTQAVELLH------SPERARKPLRHSPKPPTPP
Glyma03g29710.1         (322)  TALLELPPTQAVELLH------SPESDSARKPPNCHVSANQ
Glyma19g32570.1         (324)  TALLELPPTQAVELLH------SPESDSARKPPNCHVSANQ
POPTR_0006s05600.1      (332)  IALLELPANQAVELLH------SDSGQKQ-----------
GSVIVT01033350001       (334)  TALLGLPANQAMELLH------SQESDTAPAELSGEAWRDN
clementine0.9_011877m   (328)  TALLELPAPQAVELLHHHHHRSPESNCSTAKLVTAKADGH
clementine0.9_015567m   (330)  TALLELPAPQAVELLHHHHHRSPESNCSTAKLVTAKADGH
```

Fig. 26C

```
Bradi1g35990.1         (308) -------------------PTFPSDPSLVDRAARFSAFA
GRMZM2G074438_T01      (310) ----------------APTPTFPSDPHLVDRAGRFSTFA
Si006781m              (314) ---------------APAPTFPSDPHLVDRAARFSAFA
GRMZM2G378653_T01      (312) ---------------APAPTFPSDPHLVDRAARLSTFA
AT2G42300.1            (316) TTLHP----------FGALTFPSNSLLLDRAARFSVIA
AT3G57800.2            (318) PP-PLHS---F----GGTLAFPSNSVLMERAARFSVIA
Solyc10g079070.1.1     (336) YRYPP----------PPPIFPSDIALIDRASKFSVFA
Eucgr.A02413.1         (320) PLRRLGG---DG---GGGFALAVGSDL---AARYPALF
Glyma10g12210.1        (326) PPHPPTSPSFTASASAATANLTFPSNAALIERAARFSVFA
Glyma03g29710.1        (322) KPYLPNS---F----GSNLTFPSNAALIERAAKFSVFA
Glyma19g32570.1        (324) KPYLLNS---F----GSNLTFPSNAALIERAAKFSVFA
POPTR_0006s05600.1     (332) ---------------YPNLTFPSNTSAI----FSVFN
GSVIVT01033350001      (334) HMNPHKL---Y----YCSPTFPANTTLIDRAARFSVFA
clementine0.9_011877m  (328) GLHHPHA---TPHHFNPGANLTFPSDISLIERAVRFSVFA
clementine0.9_015567m  (330) GLHHPHA---TPHHFNPGANLTFPSDISLIERAVRFSVFA
```

Fig. 26D

| | | |
|---|---|---|
| Bradi1g35990.1 | (308) | SSNS---------------------PSPTPP |
| GRMZM2G074438_T01 | (310) | PPSP---------------------PSPSPTQQPP |
| Si006781m | (314) | SPSP---------------------SSPSPTPPPPPP |
| GRMZM2G378653_T01 | (312) | PPSP---------------------SPSSTSPAR |
| AT2G42300.1 | (316) | TEQN---------------------GNFSGETANSL |
| AT3G57800.2 | (318) | TEQQ---------------------NGNISGETPTSSV |
| Solyc10g079070.1.1 | (336) | AAGN---------------------SPESNST |
| Eucgr.A02413.1 | (320) | GEKN---------------------DSVET--- |
| Glyma10g12210.1 | (326) | GQNS--------------------------- |
| Glyma03g29710.1 | (322) | GENS---------------------PLPPEEAC |
| Glyma19g32570.1 | (324) | GENS---------------------PPPPGEAR |
| POPTR_0006s05600.1 | (332) | GGSN---------------------STDSSPV |
| GSVIVT01033350001 | (334) | AGEN---------------------SPETSSV |
| clementine0.9_011877m | (328) | GINNSDNNHNDNNNNNHKISSKIDKNNNNNNCSPETTGSV |
| clementine0.9_015567m | (330) | GINNSDNNHNDNNNNNHKISSKIDKNNNNNNCSPETTGSV |

Fig. 26E

```
Bradi1g35990.1         (308) PPPPAA------KRKADH------------------------
GRMZM2G074438_T01      (310) PPPPAA----VAGKRKADP------------------------
S1006781m              (314) PAPPAAAAAANAGKRKADQ------------------------
GRMZM2G378653_T01      (312) PLPAAA----NAGKRKADP------------------------
AT2G42300.1            (316) PSNPGA----NLDRVKAEP-AETDSMVENQN------------
AT3G57800.2            (318) PSNSSA----NLDRVKTEP-AETDS---------SQRLIS
Solyc10g079070.1.1     (336) LSNSGS----KSLFVKQEP-LDSEC---NHNSS---PATS
Eucgr.A02413.1         (320) ----------SSQKVKSEPLTESDS---NPNSS-PQPLVS
Glyma10g12210.1        (326) --NSNS----NSPEVKREL-PETDSNPSSTHGGGGGGSVS
Glyma03g29710.1        (322) LVPAGTGSVSNLDRVKNEP-QETDS---NPCSSSRLGCIS
Glyma19g32570.1        (324) LIPAGTGS--TLDRVKNEP-QETDS---NPCSSSRLGCIS
POPTR_0006s05600.1     (332) PSNSSSKDLEKASAVKCEP-LETGSYLDSSH-----PLVS
GSVIVT01033350001      (334) PSN-------SSHKVKNEP-TDTDS---NPNSL--PPLIS
clementine0.9_011877m  (328) PSNSSG----NLGKVKNEP-AESDSDNNNPNSP--QPL--
clementine0.9_015567m  (330) PSNSSG----NLGKVKNEP-AESDSDNNNPNSP--QPL--
```

Fig. 26F

```
Bradi1g35990.1          (308) ---------------AADRASKGKKGKTT--AGGSDEK------
GRMZM2G074438_T01       (310) ---------------VDRASKGKAAKK---GKTAEEKP----
Si006781m               (314) ---------------PADRASKGKSAKK---GKTAEEKP----
GRMZM2G378653_T01       (312) ---------------VDRASKGKAAKK---GKTAEEKL----
AT2G42300.1             (316) ---------------QSYSSGKRKEREKK--VKSSTKK-----
AT3G57800.2             (318) DSAIENQIPCPNQNNRNGKRKDFEKK--GKSSTKK-----
Solyc10g079070.1.1      (336) NPL---------VHQKSTKRKEREKK--VKETSKKGKKSA
Eucgr.A02413.1          (320) DPTVEN------KGQRPTKRKDREKK--AKASAKKSK---
Glyma10g12210.1         (326) DLAMEN------KNPKTAKRKEREKK--VKASSRKSKSVA
Glyma03g29710.1         (322) DPAVEN------NNQRTAKRKEREKKLTVKGSSKKSKSIA
Glyma19g32570.1         (324) DPAVEN------NIQRTAKRKEREKK--AKGSSKKRKSAA
POPTR_0006s05600.1      (332) DPTVDNSAP---NARPSSKRKEREKK--VKAASKKSKT--
GSVIVT01033350001       (334) NPTVEN------KNQRSTKRKEREKK--AKGSTKKCKNAS
clementine0.9_011877m   (328) DIKTEN------QNQKSAKRKEREKK--GKAATKKSKSGA
clementine0.9_015567m   (330) DIKTEN------QNQKSAKRKEREKK--GKAATKKSKSGA
```

Fig. 26G

| | | |
|---|---|---|
| Bradi1g35990.1 | (308) | ---DAGGGE-DEKPAYVHVRARRGQATDSHSLAERARREK |
| GRMZM2G074438_T01 | (310) | ---AAAGGE-DEKPAYVHVRARRGQATDSHSLAERARREK |
| Si006781m | (314) | ---AGGDGE-DEKPAYVHVRARRGQATDSHSLAERARREK |
| GRMZM2G378653_T01 | (312) | ---AGGDGD-DEKPAYVHVRARRGQATDSHSLAERARREK |
| AT2G42300.1 | (316) | ---NKSSVE-SDKLPYVHVRARRGQATDNHSLAERARREK |
| AT3G57800.2 | (318) | ---NKSSEE-NEKLPYVHVRARRGQATDSHSLAERARREK |
| Solyc10g079070.1.1 | (336) | ---NDTSEDGGEKLPYVHVRARRGQATDSHSLAERARREK |
| Eucgr.A02413.1 | (320) | ---NESSED-AEELPYVHVRARRGQATDSHSLAERARREK |
| Glyma10g12210.1 | (326) | AATDESSGD-GEKLPYVHVRVRRGQATDSHSLAERARREK |
| Glyma03g29710.1 | (322) | ---DETSGD-GEKLPYVHVRVRRGQATDSHSLAERARREK |
| Glyma19g32570.1 | (324) | ---DETSGD-GEKLPYVHVRVRRGQATDSHSLAERARREK |
| POPTR_0006s05600.1 | (332) | ---ESSQQE-EDMLPYVHVRARRGQATDSHSLAERARREK |
| GSVIVT01033350001 | (334) | ---NETSEE-AEKLPYVHVRARRGQATDSHSLAERARREK |
| clementine0.9_011877m | (328) | ---NDSSED-AEKLPYVHVRARRGQATDSHSLAERARREK |
| clementine0.9_015567m | (330) | ---NDSSED-AEKLPYVHVRARRGQATDSHSLAERARREK |
| consensus | (856) | RGQATDXHSLAERARREK |

Fig. 26H

| | | |
|---|---|---|
| Bradi1g35990.1 | (308) | INARMELLKELVPGCSKVSGTALVLDEIINHVQSLQRQVE |
| GRMZM2G074438_T01 | (310) | INARMELLKELVPGCSKVSGTALVLDEIINHVQSLQRQVE |
| Si006781m | (314) | INARMELLKELVPGCSKVSGTALVLDEIINHVQSLQRQVE |
| GRMZM2G378653_T01 | (312) | INARMELLKELVPGCSKVSGTALVLDEIINHVQSLQRQVE |
| AT2G42300.1 | (316) | INARMKLQELVPGCDKIQGTALVLDEIINHVQTLQRQVE |
| AT3G57800.2 | (318) | INARMKLQELVPGCDKIQGTALVLDEIINHVQSLQRQVE |
| Solyc10g079070.1.1 | (336) | INARMKLQELVPGCNKISGTAMVLDEIINHVQSLQRQVE |
| Eucgr.A02413.1 | (320) | INARMKLQELVPGCSKISGTASVLDEIINHVQSLQRQVE |
| Glyma10g12210.1 | (326) | INARMKLQELVPGCNKISGTALVLDKIINHVQSLQNEVE |
| Glyma03g29710.1 | (322) | INARMKLQELVPGCDKISGTAMVLDEIINHVQSLQRQVE |
| Glyma19g32570.1 | (324) | INARMKLQELVPGCDKISGTAMVLDEIINHVQSLQRQVE |
| POPTR_0006s05600.1 | (332) | INQRMKLQELVPGCNKISGTALVLDEIINHVQSLQCQVE |
| GSVIVT01033350001 | (334) | INARMKLQELVPGCNKISGTALVLDEIISHVQSLQRQVE |
| clementine0.9_011877m | (328) | INARMKLQELVPGCNKISGTALVLDEIINHVQSLQRQVE |
| clementine0.9_015567m | (330) | INARMKLQELVPGCNKISGTALVLDEIINHVQSLQRQVE |
| consensus | (856) | INXRMXLLXELVPGCXKXXGTAXVLDXIIXHVQXLQXXVE |

Fig. 26I

```
Bradi1g35990.1          (308)  YLSMRLAAVNPRVDFGGLDSFLTSE-CGRITGLNCKSGMD
GRMZM2G074438_T01       (310)  YLSMRLATVNPRGDFGGLDSFLTTE-CGRIASFNCKNGID
S1006781m               (314)  YLSMRLAAVNPRVDFGGLDSFLTTE-CGRIAGLNCKNGID
GRMZM2G378653_T01       (312)  YLSMRLAAVNPRVDFGGLDSFLTTE-CGRIAGFNCKNGID
AT2G42300.1             (316)  MLSMRLAAVNPRIDF-NLDSILASE-NGSL--MDGSF---
AT3G57800.2             (318)  MLSMRLAAVNPRIDF-NLDTILASE-NGSL--MDGSFNAA
Solyc10g079070.1.1      (336)  FLSMRLAAVNPRVDF-NLESLFAAERSGSH--VESNLQDM
Eucgr.A02413.1          (320)  LLSMRLAAANPRVDF-NMDNNFAE--NMSL--VDSNFPSM
Glyma10g12210.1         (326)  ILSMKLAAVNPVIDF-NLDSLLATE-GVTP--MDCNFPPT
Glyma03g29710.1         (322)  ILSMKLAAVNPRIDF-SLDSLLATD-GASL--MDNNLPSM
Glyma19g32570.1         (324)  ILSMKLAAVNPRMDF-SLDSLLATD-GASL--VDSNLPSM
POPTR_0006s05600.1      (332)  FLSMRLAAVNPRIDF-NLDSMLAAE-SGSL--IDSNFPGM
GSVIVT01033350001       (334)  FLSMRLAAVNPRIDF-NLDSLLAPE-SGSL--VDSNFPSM
clementine0.9_011877m   (328)  FLSMRLAAVNPRIDF-NLDSLFVAE-SGSL--IDSSFPGM
clementine0.9_015567m   (330)  FLSMRLAAVNPRIDF-NLDSLFVAEEVRNL----------
```

Fig. 26J

```
Bradi1g35990.1         (308) LEQVTWPDMGVHG-----ARHLMQLQQQFW-HGDLAHPHQ
GRMZM2G074438_T01      (310) LEQVTWPEMGVHG-----ARQLMQLQQQFW-HGDLAHPHQ
Si006781m              (314) LEQVTWPEMGVHG-----ARHLMQLQQQFW-HGDLAHPHQ
GRMZM2G378653_T01      (312) LEQVTWPEMGVHG-----ARQLMQLQQQFW-HGDLTHPHQ
AT2G42300.1            (316) ------------------NAESYH-QLQQW-PFDGYHQ--
AT3G57800.2            (318) PMQLAWPQQAIETEQSFHHRQLQQPPTQQW-PFDGLNQ--
Solyc10g079070.1.1     (336) VVPPIWAEGQSSG-----NRNQYQ---HLW-LIEGFHQ--
Eucgr.A02413.1         (320) VMPFMWPEVQVNE-----SRQPYH---QQW-QFNSLPQ--
Glyma10g12210.1        (326) VAPVMWPEIPQNG-----NRQQYQ---QPW-QFDAFHQ--
Glyma03g29710.1        (322) VTPLMWPEIPLNG-----NRQHYQ---QQW-QLDAFHQ--
Glyma19g32570.1        (324) VTPLMWPEIPLNG-----NRQHYQ---QQW-QLDAFHQ--
POPTR_0006s05600.1     (332) VMPLMWPEAEVNG-----NRHQFQ---QHW-QPDALHQ--
GSVIVT01033350001      (334) VMPLMWPDVQANE-----NRQPYQ---QLW-NDDTLHQ--
clementine0.9_011877m  (328) VMPVMWPELQAHG-----NRQQYQ---QQWHHFDGHHQ--
clementine0.9_015567m  (330) ----------------------------------------
```

Fig. 26K

```
Bradi1g35990.1         (308) PPSQWEKRGDVNPPVFSHSSSSLFGYDLASSGQQQPQ---
GRMZM2G074438_T01      (310) VASQWEKRGDHPPVFSNSSPSLFGYDLTSSGKPCTQSYI
Si006781m              (314) APSQWEKRGDHPPVFSSSSPSLFGYDLTSSGAQQPP---
GRMZM2G378653_T01      (312) VASQWEKRGDHPPVFSNSSPSLFGYDLTSSGAQQTP---
AT2G42300.1            (316) --PEWGREEDHHQANF----------SMGSATLH----
AT3G57800.2            (318) --PVWG-REEDQAHGNDNSNLMAVSENVMVASANLH----
Solyc10g079070.1.1     (336) --PAWG-R-LEDNSSFVTPENSLLTYDSSANSASLH----
Eucgr.A02413.1         (320) --PVWG-R-EQDNHNFITPENSLLSYDSPANSDFEYCLDS
Glyma10g12210.1        (326) --PLWG-R-EEDNTN-MTPENSLWSYDSSANSVSLH----
Glyma03g29710.1        (322) --PLWE-R-EEVNHNFMTPENSLLSYDSSANSAAVQPVYI
Glyma19g32570.1        (324) --PLWE-R-EEVNHNFMTPENSLLSYDSSANSASLH----
POPTR_0006s05600.1     (332) --PIWG-R-EEDSHNFITPENSLLSYDSSANSGKKQKNER
GSVIVT01033350001      (334) --PVWG-REEDDPHNFIAPEHSLLSYDSSANSGSLQ----
clementine0.9_011877m  (328) --PLLG--GAEESHNFVTPENSLLSYDSSANSATLH----
clementine0.9_015567m  (330) ---------------------------------------
```

Fig. 26L

```
Bradi1g35990.1         (308) ------------------------PNKLKTEL----------
GRMZM2G074438_T01      (310) TFLNEFSCLSLTSHITAWLA--PQLLSLSLSRQCSLENKV
Si006781m              (314) ------------------------ASKLKTEL----------
GRMZM2G378653_T01      (312) ------------------------ASKLKTEL----------
AT2G42300.1            (316) ------------------------PNQVKMEL----------
AT3G57800.2            (318) ------------------------PNQVKMEL----------
Solyc10g079070.1.1     (336) ------------------------PNQLKMEL----------
Eucgr.A02413.1         (320) WGVIQFS-------------YEQINRKLEVLVVVLSLH
Glyma10g12210.1        (326) ------------------------SNQLKMEL----------
Glyma03g29710.1        (322) VVLPSDPLSSTMRHCFLRWTKEYGDQTLELTR---------
Glyma19g32570.1        (324) ------------------------LNQLKMEL----------
POPTR_0006s05600.1     (332) NQRPSL--------------SHDVCLSYE---------
GSVIVT01033350001      (334) ------------------------SNQLKMEL----------
clementine0.9_011877m  (328) ------------------------TNQLKMEL----------
clementine0.9_015567m  (330) ------------------------------------------
```

Fig. 26M

| | | |
|---|---|---|
| Bradi1g35990.1 | (308) | ------------ |
| GRMZM2G074438_T01 | (310) | Y----------- |
| Si006781m | (314) | ------------ |
| GRMZM2G378653_T01 | (312) | ------------ |
| AT2G42300.1 | (316) | ------------ |
| AT3G57800.2 | (318) | ------------ |
| Solyc10g079070.1.1 | (336) | ------------ |
| Eucgr.A02413.1 | (320) | SRATENGAMKVD |
| Glyma10g12210.1 | (326) | ------------ |
| Glyma03g29710.1 | (322) | ------------ |
| Glyma19g32570.1 | (324) | ------------ |
| POPTR_0006s05600.1 | (332) | ------------ |
| GSVIVT01033350001 | (334) | ------------ |
| clementine0.9_011877m | (328) | ------------ |
| clementine0.9_015567m | (330) | ------------ |

Fig. 26N

```
Solyc03g111450.1.1  (372)  --MENNDQQPMEINQQQPMENNDQQAMEINQQQPMENNDQ
AT5G50470.1         (354)  ------------------MEENNGNNNHYLPQPSSSQLP
LOC_Os08g10560.1    (346)  MLSSMFLFLLPLSLLSFSLLGNLWAGAATSAGEGWSSVGL
Si015775m           (348)  ----------------------PASQGA-----------
Bradi3g17790.1      (338)  ------------------MDQHSQTKVEDVVM-------
Bradi3g17820.1      (342)  ---------------------------------------
Bradi3g17800.1      (340)  ------------------MNQHSQPRTEADAT--NDTPVAYV
Bradi3g17810.1      (344)  ------------------MDGHSQPWAEADATNVNSTPVAYV
Solyc03g111460.1.1  (368)  ------------------MASHSDPVAANAEVAAAVNA----
Solyc03g111470.1.1  (370)  ------------------MASHSDPMAANVEVATSVNAEAAA
Solyc02g021330.1.1  (360)  --------------------MKNNPDKLVVNATQSST----
Solyc03g110840.1.1  (362)  ------------------MSELSNVEKTTMKNNSEKSIVN--
Solyc00g107050.1.1  (358)  ----------------------MENNSEKSTVNATQS-----
Solyc03g110850.1.1  (364)  ----------------------MENNYEKSAVNAGQS-----
Solyc11g016920.1.1  (366)  ----------------------MENNSEKSAVNAGQS-----
AT5G50480.1         (356)  ------------------MAENNNNGDNMNNDNHQQ-----
AT5G27910.1         (350)  ----------------------MENNGNN-----------
AT5G50490.1         (352)  ----------------------MENNMNNH----------
```

Fig. 28A

```
Solyc03g111450.1.1  (372)  QPMEINQQQPVEPLYPG---------------------------
AT5G50470.1         (354)  P-------------------------------------------
LOC_Os08g10560.1    (346)  RLMLLGGATPFFYINIETVIITNMNYYPEGSNPVYFAVLV
Si015775m           (348)  --------------------------------------------
Bradi3g17790.1      (338)  ----VSGAPS------AG---------TAFPAGSN---------
Bradi3g17820.1      (342)  --------------------------------------------
Bradi3g17800.1      (340)  A-GTVYGVAP-----VG-VIFPAGTVFHVGPR------------
Bradi3g17810.1      (344)  APGTVSGAAP-----AGAAAFPAGTVFAAGSS------------
Solyc03g111460.1.1  (368)  --------------------------------------------
Solyc03g111470.1.1  (370)  AAVNVK--------------------------------------
Solyc02g021330.1.1  (360)  --------------------------------------------
Solyc03g110840.1.1  (362)  --------------------------------------------
Solyc00g107050.1.1  (358)  --------------------------------------------
Solyc03g110850.1.1  (364)  --------------------------------------------
Solyc11g016920.1.1  (366)  --------------------------------------------
AT5G50480.1         (356)  --------------------------------------------
AT5G27910.1         (350)  --------------------------------------------
AT5G50490.1         (352)  --------------------------------------------
```

Fig. 28B

| | | |
|---|---|---|
| Solyc03g111450.1.1 | (372) | ---------------------------------------- |
| AT5G50470.1 | (354) | ---------------------------------------- |
| LOC_Os08g10560.1 | (346) | KYEDLDGDVVQVDLMESKSAYGGAIGVWTPMRESWGSASA |
| Si015775m | (348) | ---------------------------------------- |
| Bradi3g17790.1 | (338) | ------------------GG-------------------- |
| Bradi3g17820.1 | (342) | ---------------------------------------- |
| Bradi3g17800.1 | (340) | ------------------GG-------------------- |
| Bradi3g17810.1 | (344) | ------------------GG-------------------- |
| Solyc03g111460.1.1 | (368) | ---------------------------------------- |
| Solyc03g111470.1.1 | (370) | ---------------------------------------- |
| Solyc02g021330.1.1 | (360) | ---------------------------------------- |
| Solyc03g110840.1.1 | (362) | ---------------------------------------- |
| Solyc00g107050.1.1 | (358) | ---------------------------------------- |
| Solyc03g110850.1.1 | (364) | ---------------------------------------- |
| Solyc11g016920.1.1 | (366) | ---------------------------------------- |
| AT5G50480.1 | (356) | ---------------------------------------- |
| AT5G27910.1 | (350) | ---------------------------------------- |
| AT5G50490.1 | (352) | ---------------------------------------- |

Fig. 28C

```
Solyc03g111450.1.1  (372) --------------YPFYQMLLHQQHQQLQL---------
AT5G50470.1         (354) --------------PPLYYQSMPLPSY--------------
LOC_Os08g10560.1    (346) VTSARPFVTNNVIPAIWSRI-APSLPPSPLPRRPRSALAH
Si015775m           (348) --------------PTAYQTAIPPPLSNQHQAA--------
Bradi3g17790.1      (338) --------------PVVYAAA---PLQQ-------------
Bradi3g17820.1      (342) -----------------------------------------
Bradi3g17800.1      (340) --------------P-IYAAT---PVKQEDQHQQQLQAFWT
Bradi3g17810.1      (344) --------------PVVYAAT---PLQQ-------------
Solyc03g111460.1.1  (368) --------------EEEVAEATAQPIVN-------------
Solyc03g111470.1.1  (370) --------------AVAVAEATAQPVVN-------------
Solyc02g021330.1.1  (360) --------------HPTLAQL--------------------
Solyc03g110840.1.1  (362) -----------------------------------------
Solyc00g107050.1.1  (358) --------------VDAYSTMSHL-----------------
Solyc03g110850.1.1  (364) --------------AAYPMLSPPHLE---------------
Solyc11g016920.1.1  (366) --------------DVYSMLALPHLE---------------
AT5G50480.1         (356) --------------PPSYSQL--------------------
AT5G27910.1         (350) -----------------------------------------
AT5G50490.1         (352) -----------------------------------------
```

Fig. 28D

```
Solyc03g111450.1.1  (372) ------------------------------------
AT5G50470.1         (354) ------------------------------------
LOC_Os08g10560.1    (346) CRASPASVSPSARASPTPPSPRSPPHRPSRSRHLLLSGIP
Si015775m           (348) ------------------------------------
Bradi3g17790.1      (338) ------------------------------------
Bradi3g17820.1      (342) ------------------------------------
Bradi3g17800.1      (340) DRLDEIEHMSDFKIHSLPLARIKKIMKASGENVHMIAGEA
Bradi3g17810.1      (344) ------------------------------------
Solyc03g111460.1.1  (368) ------------------------------------
Solyc03g111470.1.1  (370) ------------------------------------
Solyc02g021330.1.1  (360) ------------------------------------
Solyc03g110840.1.1  (362) ------------------------------------
Solyc00g107050.1.1  (358) ------------------------------------
Solyc03g110850.1.1  (364) ------------------------------------
Solyc11g016920.1.1  (366) ------------------------------------
AT5G50480.1         (356) ------------------------------------
AT5G27910.1         (350) ------------------------------------
AT5G50490.1         (352) ------------------------------------
```

Fig. 28E

```
Solyc03g111450.1.1  (372)  ----------------------------------------
AT5G50470.1         (354)  ----------------------------------------
LOC_Os08g10560.1    (346)  AAALVVACPNLNDLDFSNDHYGSTSGMRRRRRWPSCVGFW
Si015775m           (348)  ----------------------------------------
Bradi3g17790.1      (338)  ----------------------------------------
Bradi3g17820.1      (342)  ----------------------------------------
Bradi3g17800.1      (340)  PGVLPKACEIFIQELTLRSWLQTREKNRR-----------
Bradi3g17810.1      (344)  ----------------------------------------
Solyc03g111460.1.1  (368)  ----------------------------------------
Solyc03g111470.1.1  (370)  ----------------------------------------
Solyc02g021330.1.1  (360)  ----------------------------------------
Solyc03g110840.1.1  (362)  ----------------------------------------
Solyc00g107050.1.1  (358)  ----------------------------------------
Solyc03g110850.1.1  (364)  ----------------------------------------
Solyc11g016920.1.1  (366)  ----------------------------------------
AT5G50480.1         (356)  ----------------------------------------
AT5G27910.1         (350)  ----------------------------------------
AT5G50490.1         (352)  ----------------------------------------
```

Fig. 28F

```
Solyc03g111450.1.1  (372) ------------------------------------
AT5G50470.1         (354) ------------------------------------
LOC_Os08g10560.1    (346) GGFGDGDGDRYSITFSAYIVVLRTQEAYVQILQQLHRSTS
Si015775m           (348) ------------------------------------
Bradi3g17790.1      (338) ------------------------------------
Bradi3g17820.1      (342) ------------------------------------
Bradi3g17800.1      (340) ---------------------------TLLRHKCMYLLA
Bradi3g17810.1      (344) ----------------------------VRH--------
Solyc03g111460.1.1  (368) ------------------------------------
Solyc03g111470.1.1  (370) ------------------------------------
Solyc02g021330.1.1  (360) ------------------------------------
Solyc03g110840.1.1  (362) ------------------------------------
Solyc00g107050.1.1  (358) ------------------------------------
Solyc03g110850.1.1  (364) ------------------------------------
Solyc11g016920.1.1  (366) ------------------------------------
AT5G50480.1         (356) ------------------------------------
AT5G27910.1         (350) ------------------------------------
AT5G50490.1         (352) ------------------------------------
```

Fig. 28G

```
Solyc03g111450.1.1  (372)  ----------------------------------------
AT5G50470.1         (354)  ----------------------------------------
LOC_Os08g10560.1    (346)  LEMDPHSHKKAHEGLIGDNPDAYAVTTYQPVLMVEPSAAA
Si015775m           (348)  ----------------------------------------
Bradi3g17790.1      (338)  ----------------------------------------
Bradi3g17820.1      (342)  ----------------------------------------
Bradi3g17800.1      (340)  MDQHSQPRTEADATNDTSVAYLAGTESGPAPAGVVFPAGT
Bradi3g17810.1      (344)  ----------------------------------------
Solyc03g111460.1.1  (368)  ----------------------------------------
Solyc03g111470.1.1  (370)  ----------------------------------------
Solyc02g021330.1.1  (360)  ----------------------------------------
Solyc03g110840.1.1  (362)  ----------------------------------------
Solyc00g107050.1.1  (358)  ----------------------------------------
Solyc03g110850.1.1  (364)  ----------------------------------------
Solyc11g016920.1.1  (366)  ----------------------------------------
AT5G50480.1         (356)  ----------------------------------------
AT5G27910.1         (350)  ----------------------------------------
AT5G50490.1         (352)  ----------------------------------------
```

Fig. 28H

```
Solyc03g111450.1.1  (372)  ----------------------------------QLQQQVEEQ
AT5G50470.1         (354)  ----------------------------------SLPLPYSPQ
LOC_Os08g10560.1    (346)  AFPPAPQVAPAYPVNPMQLPEHQQHAIQQVQQLQQQQKEQ
Si015775m           (348)  ----------------------------------LLQKLQQQ
Bradi3g17790.1      (338)  --------------QLPL----------------QKQEVQQQ
Bradi3g17820.1      (342)  ---------------------------------------
Bradi3g17800.1      (340)  VFHVGPYGGPVYAALPM-----------------QQEDQHQQQ
Bradi3g17810.1      (344)  ---------------PL-----------------QQEDQHQQK
Solyc03g111460.1.1  (368)  ----------------------------------ANDYLLQQQ
Solyc03g111470.1.1  (370)  ----------------------------------ANNYLLQQQ
Solyc02g021330.1.1  (360)  ----------------------------------NIVKNKQEQ
Solyc03g110840.1.1  (362)  ----------------------------------AAQSTGYPT
Solyc00g107050.1.1  (358)  ----------------------------------NIEKIEQEY
Solyc03g110850.1.1  (364)  ---------------------------------------KKQEK
Solyc11g016920.1.1  (366)  ---------------------------------------KKQEK
AT5G50480.1         (356)  ----------------------------------PPMASSNPQ
AT5G27910.1         (350)  ----------------------------------QLPPKGNEQ
AT5G50490.1         (352)  ----------------------------------QQPPKDNEQ
```

Fig. 28I

```
Solyc03g111450.1.1  (372) MRIFWNCQREEIEEMDDFKHHHF-PISRIKRIIKSE-NNA
AT5G50470.1         (354) MRNYWI---AQMGNATDVKHHAF-PLTRIKKIMKSN-PEV
LOC_Os08g10560.1    (346) LQAFWADQMAEVEQMTEFKLPNL-PLARIKKIMKAD-EDV
Si015775m           (348) LQAFWAGQLAEAEQATDLKVHSL-PLARIKKIMKAD-EDV
Bradi3g17790.1      (338) LQTFWADRKTEIEQITDCKTHSL-PLARIKKIMKAD-EDV
Bradi3g17820.1      (342) ---------------MSDFKIHSL-PLERIKKIMKASGENV
Bradi3g17800.1      (340) LQAFWSDRLDEIEHMSDFKTHSL-PLARIKKIMKASGENV
Bradi3g17810.1      (344) LQDFWTETLAEIEHMSEIKPHSL-PLARIKKIMKASGEDI
Solyc03g111460.1.1  (368) LRLFWAAQLQEIIQIRDFRGHSL-PISRIKKIMKSD-KEV
Solyc03g111470.1.1  (370) LQLFWAAQLQEIMQIGDFEGHSL-PIFRIKKIMKSD-KEV
Solyc02g021330.1.1  (360) LEMFWTNQRREIENDNEFKNHLLPPNLIKKLMKTD-EDD
Solyc03g110840.1.1  (362) LEMFWKSQQSQMENIKDFKDRLLPPTRIKKIMKKN-EDV
Solyc00g107050.1.1  (358) MEMFWTDQEREMEKIDNFKNULLVSPNRIKNIMKTN-KDV
Solyc03g110850.1.1  (364) LEMFWTDKRREMENVIDFKSULLPRIHRIKKIMKTD-KDV
Solyc11g016920.1.1  (366) LEMFWIDKQREMENVIDFKSULLPSINRIKKIMKTD-KDV
AT5G50480.1         (356) LRNYWI---EQMETVSDFKNRQL-PLARIKKIMKAD-PDV
AT5G27910.1         (350) LKSFWS---KEMEGNLDFKNHDL-PITRIKKIMKYD-PDV
AT5G50490.1         (352) LKSFWS---KGMEGDLNVKNHEF-PISRIKRIMKFD-PDV
consensus           (857)                        XXXXXXXXIKXXXKXXXXXX
```

Fig. 28J

| | | |
|---|---|---|
| Solyc03g111450.1.1 | (372) | IKLSAETPILFSKACELFVLELTLRSWFHAQQNNRGSLK- |
| AT5G50470.1 | (354) | NMVTAEAPVLISKACEMLILDLTMRSWLHTVEGGRQTLKR |
| LOC_Os08g10560.1 | (346) | KMIAGEAPALFAKACEMFILDMTLRSWQHTEEGRRRTLQ- |
| Si015775m | (348) | KMIAAEAPVVFAKACEMFILELTLRSWLHTEGTKRRTMQ- |
| Bradi3g17790.1 | (338) | QMIAGEAPAVFAKACEMFILELTLRSWLQTRENNRNTLQ- |
| Bradi3g17820.1 | (342) | QVIAGEAPGVLTKACEIFIQELTLRSWLQTREKNRRTLQ- |
| Bradi3g17800.1 | (340) | QMIAGEAHGLLAKACEIFIQELTLRSWLQTRENNRRTLQ- |
| Bradi3g17810.1 | (344) | RMIASEAPGLLAKASEIFIQELTLRSWLETRDNNRRTLQ- |
| Solyc03g111460.1.1 | (368) | RMISAESPILLAKACELFIQELTHRSWLKAQECQRQTLK- |
| Solyc03g111470.1.1 | (370) | RMISAESPILLDKACELFIQELTHRSWLKAQECQRRTLK- |
| Solyc02g021330.1.1 | (360) | QMIAAESPVLLAKTCELFIQELTLRSWLNAQEKHQHILK- |
| Solyc03g110840.1.1 | (362) | RMVAGESPVLLAKACELFIQDLTLRSSIHAQENHRRILK- |
| Solyc00g107050.1.1 | (358) | RRITSESPVLLAKACDFFIQELTLRSWLNAQENHRRILK- |
| Solyc03g110850.1.1 | (364) | RMIATESPVLLAKACELFIQELTLRSWFKAEENHRRILK- |
| Solyc11g016920.1.1 | (366) | RMIATESPVLLAKACELFIQELTLRSWFKTEKNHRRILK- |
| AT5G50480.1 | (356) | HMVSAEAPIIFAKACEMFIVDLTMRSWLKAEENKRHTLQ- |
| AT5G27910.1 | (350) | TMIASEAPILLSKACEMFIMDLTMRSWLHAQESKRVTLQ- |
| AT5G50490.1 | (352) | SMIAAEAPNLLSKACEMFVMDLTMRSWLHAQESNRLTIR- |
| consensus | (857) | XXXXEXXXXXXXXXXXXXXXXTXRSXXXXXXXXXXXXXX |

Fig. 28K

```
Solyc03g111450.1.1  (372) -----KTDFAAIRRTEVF--DFLADVVPEDEINEVATGF
AT5G50470.1         (354) SDTLTRSDISAATTRSFKF--TFLGDVVP----RDPSV--
LOC_Os08g10560.1    (346) -----RSDVEAVKKTDIF--DFLVDIITDDKMKDDGM--
Si015775m           (348) -----RSDVSAAIMANEMF--DFLMDVTPTEQ-QTNGD--
Bradi3g17790.1      (338) -----KNDIATVVSRNDDF--DFLVDVM-----QENGA--
Bradi3g17820.1      (342) -----KNDIAAVSRNEAF--DFLVDIM-----QDNGV--
Bradi3g17800.1      (340) -----KNDIAAVSRNEAF--DFLVDIM-----QDNGA--
Bradi3g17810.1      (344) -----KNDIGAVSRNETF--DFLVDVM-----QDNGV--
Solyc03g111460.1.1  (368) -----KIDFTVLKETELF--DFLVDVISMDE-PEEEAPT
Solyc03g111470.1.1  (370) -----KIDFFTIEEAPTYVPGMLGNI------PNHIP--
Solyc02g021330.1.1  (360) -----KDDVTDVIQTDNL--DFLLVVV-----DDAID--
Solyc03g110840.1.1  (362) -----KDDLIDVIVQTDYF--DFLLDVV-----HRNGA--
Solyc00g107050.1.1  (358) -----KKDVTDVIKRNDNL--NFLFD------DDVNS--
Solyc03g110850.1.1  (364) -----KDDVTDVIMETDTL--DFLLD------DDANV--
Solyc11g016920.1.1  (366) -----KDDVTDVIMETDIL--DFLLD------DDADV--
AT5G50480.1         (356) -----KSDISNAVASSFTY--DFLLDVVP----KDESI--
AT5G27910.1         (350) -----KSNVDAAVAQTVIF--DFLLD------DDIEV--
AT5G50490.1         (352) -----KSDVDAVVSQTVIF--DFLRDDVP----KDEGE--
consensus           (857) XXXXXXXXXXXXX
```

Fig. 28L

```
Solyc03g111450.1.1  (372)  GPGMVGPTVGGGFPYFYPPMGLLAMPGVMPGGPAMLGVMP
AT5G50470.1         (354)  ------------------------VTDDPVLHP-------D
LOC_Os08g10560.1    (346)  ----------------GS--Q-------AASMVS------P
Si015775m           (348)  ----------------GVLPP-------PPPLQT------T
Bradi3g17790.1      (338)  ---------------------------VLPPV--------T
Bradi3g17820.1      (342)  ---------------------------GLPTG--------T
Bradi3g17800.1      (340)  ---------------------------GLPTG--------T
Bradi3g17810.1      (344)  ---------------------------GFPSA--------T
Solyc03g111460.1.1  (368)  YVPGMLGNIPNRISYYYSP--------MGPPAP-------P
Solyc03g111470.1.1  (370)  ---------------YCYSP--------MGPPAP-------P
Solyc02g021330.1.1  (360)  ---------------------------GSTPSI-------V
Solyc03g110840.1.1  (362)  ---------------------------TDPFT--------P
Solyc00g107050.1.1  (358)  ----------------------------------------
Solyc03g110850.1.1  (364)  ----------------------------TDGS--------T
Solyc11g016920.1.1  (366)  ----------------------------------------
AT5G50480.1         (356)  ------------------ATADP-----GFVAMPHP----D
AT5G27910.1         (350)  ----------KRESVAAAADP-------VAMPPI------D
AT5G50490.1         (352)  ----------PVVAAADPVDDVADHVAVPDL---------N
```

Fig. 28M

```
Solyc03g111450.1.1  (372)  GGPAMLGPMPGGPAMPGPMIGGPSMPGPMIGGPAVAVVAP
AT5G50470.1         (354)  GEVL-----PPGTVIGYPVFDCNGVYASPPQMQ-------
LOC_Os08g10560.1    (346)  Y--T-----SGGMGFSFDLY-PN-QHHLAY----------
Si015775m           (348)  AGQV-----PFPMHVPFPMYA---NHQPPF----------
Bradi3g17790.1      (338)  LQTM-----VPGMGIPFGMY-GN-QLPTAF----------
Bradi3g17820.1      (342)  MQTM-----IPGMG-TFGMYYEN-LISNQFLSRGRSRSSS
Bradi3g17800.1      (340)  MQTM-----VPGMG-TFEMYCGN-QQPVPF----------
Bradi3g17810.1      (344)  VQTA-----VLGMS-TFGMYYGNQQPVPF-----------
Solyc03g111460.1.1  (368)  MAPL-----APSVRPPAPSMGPPAPSMPTSPRGIMGRRAM
Solyc03g111470.1.1  (370)  MAPL-----APSMGPPAPSMEPPAPSMPAPPRGIMGRRAM
Solyc02g021330.1.1  (360)  ----------------------------------------
Solyc03g110840.1.1  (362)  NSV-------------------------------------
Solyc00g107050.1.1  (358)  ----------------------------------------
Solyc03g110850.1.1  (364)  QNVV------------------------------------
Solyc11g016920.1.1  (366)  ------------AFDV------------------------
AT5G50480.1         (356)  GGGVPQYYYPPGVVMGTPMV-GSGMYAPSQ----------
AT5G27910.1         (350)  DGEL-----PPGMVIGTPVCCSLGIHQPQPQMQ-------
AT5G50490.1         (352)  NEEL-----PPGTVIGTPVCYGLGIHAPHPQMPG------
```

Fig. 28N

```
Solyc03g111450.1.1  (372)  S------VY----------------------VQ
AT5G50470.1         (354)  -------EW----------------------
LOC_Os08g10560.1    (346)  -------MW---------------------PPQ
Si015775m           (348)  -------MW---------------------
Bradi3g17790.1      (338)  -------AW---------------------PQP
Bradi3g17820.1      (342)  SRLTTLPSWNHNRRTLQKNDIAATVSRNDTFDFLMDIMQE
Bradi3g17800.1      (340)  -------AW---------------------PQP
Bradi3g17810.1      (344)  -------AW---------------------LQP
Solyc03g111460.1.1  (368)  -------PW---------------VAPSMHVPPPLY
Solyc03g111470.1.1  (370)  -------PW---------------VTTSMHVPPPLY
Solyc02g021330.1.1  (360)  ----------------------------------
Solyc03g110840.1.1  (362)  ----------------------------------
Solyc00g107050.1.1  (358)  ----------------------------------
Solyc03g110850.1.1  (364)  ----------------------------------
Solyc11g016920.1.1  (366)  ----------------------------------
AT5G50480.1         (356)  -------AW---------------------
AT5G27910.1         (350)  -------AW---------------------
AT5G50490.1         (352)  -------AW---------------------
```

Fig. 28O

```
Solyc03g111450.1.1  (372)  PPLQAWQPAG----------------------------------
AT5G50470.1         (354)  ----PAVPGD----------------------------------
LOC_Os08g10560.1    (346)  EQQEQWPPQE----------------------------------
Si015775m           (348)  ----PTPEYQ----------------------------------
Bradi3g17790.1      (338)  EQQ-PPYNGE----------------------------------
Bradi3g17820.1      (342)  NENKPVHTEEVHLGHGSTLTATNNTLAMDQPIQALGRVHL
Bradi3g17800.1      (340)  QQQQSPHNGE----------------------------------
Bradi3g17810.1      (344)  EHQPPPYNGE----------------------------------
Solyc03g111460.1.1  (368)  PRKFGWYAAG----------------------------------
Solyc03g111470.1.1  (370)  PRQFGWYAAG----------------------------------
Solyc02g021330.1.1  (360)  ----PFYIAG----------------------------------
Solyc03g110840.1.1  (362)  ----PLYAAG----------------------------------
Solyc00g107050.1.1  (358)  --------------------------------------------
Solyc03g110850.1.1  (364)  ----PFYVAE----------------------------------
Solyc11g016920.1.1  (366)  --------------------------------------------
AT5G50480.1         (356)  ----PAAAGD----------------------------------
AT5G27910.1         (350)  --PGAWTSVS----------------------------------
AT5G50490.1         (352)  --------------------------------------------
```

Fig. 28P

```
Solyc03g111450.1.1  (372) ---------------------------------DNPNA
AT5G50470.1         (354) ---------------------------------GEEAA
LOC_Os08g10560.1    (346) ---------------------------------QQEQK
Si015775m           (348) ---------------------------------QQQNP
Bradi3g17790.1      (338) ---------------------------------QQQE-
Bradi3g17820.1      (342) DALGRAGDGVDEDEDNAVAPRGRPAAVSRIVGAQAKKTQP
Bradi3g17800.1      (340) ---------------------------------QQHQP
Bradi3g17810.1      (344) ---------------------------------QQQQP
Solyc03g111460.1.1  (368) ---------------------------------GNPYL
Solyc03g111470.1.1  (370) ---------------------------------DNPYA
Solyc02g021330.1.1  (360) ---------------------------------GNN--
Solyc03g110840.1.1  (362) ---------------------------------GSNEE
Solyc00g107050.1.1  (358) ---------------------------------------
Solyc03g110850.1.1  (364) ---------------------------------GTMGV
Solyc11g016920.1.1  (366) ---------------------------------------
AT5G50480.1         (356) ---------------------------------GEDDA
AT5G27910.1         (350) ---------------------------------GEEEE
AT5G50490.1         (352) ---------------------------------TEEDA
```

Fig. 28Q

```
Solyc03g111450.1.1  (372) ----------------------------------------G
AT5G50470.1         (354) ----------------------------------------G
LOC_Os08g10560.1    (346) --------------------------------------QKQ
Si015775m           (348) ----------------------------------------
Bradi3g17790.1      (338) --------------------------------EEEEEEEE
Bradi3g17820.1      (342) LGKAPDSFMCGRAGAGCAEAAAELDLWRRLRHPSSSGEQR
Bradi3g17800.1      (340) ---------------------------------PYNGEQQQ
Bradi3g17810.1      (344) ----------------------------------------P
Solyc03g111460.1.1  (368) ---------------------------------KVMPLLIQ
Solyc03g111470.1.1  (370) ---------------------------------------TR
Solyc02g021330.1.1  (360) ----------------------------------------
Solyc03g110840.1.1  (362) ----------------------------------------
Solyc00g107050.1.1  (358) ----------------------------------------
Solyc03g110850.1.1  (364) ----------------------------------------
Solyc11g016920.1.1  (366) ----------------------------------------
AT5G50480.1         (356) ----------------------------------------E
AT5G27910.1         (350) ---------------------------------------AR
AT5G50490.1         (352) ----------------------------------------T
```

Fig. 28R

```
Solyc03g111450.1.1  (372)  GESDGQGGIFLLFLRSDEGNVERRRV---------------------
AT5G50470.1         (354)  EIGGSSGGN--------------------------------------
LOC_Os08g10560.1    (346)  DSDGGGQDE--------------------------------------
Si015775m           (348)  ----GGGNE--------------------------------------
Bradi3g17790.1      (338)  PPYNGGQDV--------------------------------------
Bradi3g17820.1      (342)  DASGGGRREESGIGLSPATMQTIVPAGDRHSLSLGRSRSS
Bradi3g17800.1      (340)  PPSSGGQDE--------------------------------------
Bradi3g17810.1      (344)  PPSSDGQDE--------------------------------------
Solyc03g111460.1.1  (368)  MLSGTGTTEALSGMMEPPRLIGYRMISKPSGAIWRSGH--
Solyc03g111470.1.1  (370)  GSSGQGSGDPQSGMMEPPRLIGYRMISKPSGAIWRSGH--
Solyc02g021330.1.1  (360)  -----------------------------------------------
Solyc03g110840.1.1  (362)  --DGNNLDQ--------------------------------------
Solyc00g107050.1.1  (358)  -TGGNNGHT--------------------------------------
Solyc03g110850.1.1  (364)  HTDNLDHQM--------------------------------------
Solyc11g016920.1.1  (366)  -----------------------------------------------
AT5G50480.1         (356)  DNGGNGGGN--------------------------------------
AT5G27910.1         (350)  GKKGGDDGN--------------------------------------
AT5G50490.1         (352)  GANGGNGGN--------------------------------------
```

Fig. 28S

| | | |
|---|---|---|
| Solyc03g111450.1.1 | (372) | ------------ |
| AT5G50470.1 | (354) | ------------ |
| LOC_Os08g10560.1 | (346) | ------------ |
| Si015775m | (348) | ------------ |
| Bradi3g17790.1 | (338) | ------------ |
| Bradi3g17820.1 | (342) | SSSHLRMVDKRN |
| Bradi3g17800.1 | (340) | ------------ |
| Bradi3g17810.1 | (344) | ------------ |
| Solyc03g111460.1.1 | (368) | ------------ |
| Solyc03g111470.1.1 | (370) | ------------ |
| Solyc02g021330.1.1 | (360) | ------------ |
| Solyc03g110840.1.1 | (362) | ------------ |
| Solyc00g107050.1.1 | (358) | ------------ |
| Solyc03g110850.1.1 | (364) | ------------ |
| Solyc11g016920.1.1 | (366) | ------------ |
| AT5G50480.1 | (356) | ------------ |
| AT5G27910.1 | (350) | ------------ |
| AT5G50490.1 | (352) | ------------ |

Fig. 28T

```
AT4G36060.1         (380) MDQ--------------------PMKPKTCSESDFADD
LOC_Os02g23823.1    (376) MDP--------------------RSSQAQEDGFFHPRD
Brad13g11520.1      (374) MDP--------------------RPHKPQDDRYFHQHD
Si017804m           (378) MDP--------------------RGHQPPEDGFFHPRD
GRMZM2G114444_T02   (408) MSS--------------------SGPLPA-TGTHHG--
Glyma07g26910.1     (382) MDQ------RKLRDSSNSKPASDAAPQHVTLTSNRFRNSQ
POPTR_0005s11550.1  (384) MDQWNTRNDYAQSFVAATTNMVPSNSLHSFPPRSSTRLQN
GSVIVT01018777001   (386) MDQWKADDFTQSV-----------APELAPSNPLSLPSS
Solyc01g111130.2.1  (406) MDQFNHGGLYQSNQLPN------HCLTELNQLPSDVSTPPN
AT3G19860.1         (388) ----------------------------------------
GSVIVT01024084001   (404) MDH-------------QNPEAFCQSTHYPPPDPRVSST-
Glyma12g02740.1     (398) ----------------------------------------
Glyma08g15740.1     (394) ----------------------------------------
Glyma15g29630.1     (396) ----------------------------------------
clementine0.9_014901m (390) MDPQLKNEAALVQSIPPPNPTLLEYRQPQPPPDPR-VPTT
clementine0.9_014926m (392) MDPQLKNEAALVQSIPPPNPTLLEYRQPQPPPDPR-VPTT
POPTR_0004s17540.1  (400) MDP-------------------FTDFNPPPPPVPRHVPPT
POPTR_0009s13220.1  (402) MDPF------------------TDFNPPPAVPRHVPST
```

Fig. 30A

```
AT4G36060.1          (380) SSASSSSSSGQNLRGAEMVVEVKKEAVCSQKAEREKLRRD
LOC_Os02g23823.1     (376) GACPADSSGKTECKTQGSIA-TRK----VQKADREKMRRD
Bradi3g11520.1       (374) GACHADPSQRAECKAQGLVT-VRK----VQKADRERMRRD
Si017804m            (378) ----ADMSQRTECKAQGPSS-ARK----VQKADREKMRRD
GRMZM2G114444_T02    (408) -------SQRAECKSQGSTS-ARK----VQKADREKMRRD
Glyma07g26910.1      (382) AAVREREKEKGEGENEDPSA-ARK----VLKADREKLRRD
POPTR_0005s11550.1   (384) SALEP--RQRQEVEVKNPIAVKK----VQKADREKLRRD
GSVIVT01018777001    (386) NNRLPEARQRTEVEAKDSIA-ARK----VQKADREKLRRD
Solyc01g111130.2.1   (406) GLLSESSKQKPEAELKDSIA-ARK----VQKADREKLRRD
AT3G19860.1          (388) ----------------MDVS-ARK----SQKAGREKLRRE
GSVIVT01024084001    (404) -RSHPDSSKRSEGEFKDFVT-ARK----VQKADREKLRRD
Glyma12g02740.1      (398) ----------------MDCTA-ARK----TQKADREKLRRD
Glyma08g15740.1      (394) ----------------MDCSA-ARK----TQKADREKLRRD
Glyma15g29630.1      (396) -MITPLEVNEPEVEPMDCSA-ARK----TQKADREKLRRD
clementine0.9_014901m (390) -RPQSKSSQKNEGEVKDCAA-TRK----MQKADREKLRRD
clementine0.9_014926m (392) -RPQSKSSQKNEGEVKDCAA-TRK----MQKADREKLRRD
POPTR_0004s17540.1   (400) -RPNP-NPKSSEAEIKDSVS-ARK----IQKADREKLRRD
POPTR_0009s13220.1   (402) -HPDPISS---EAELKDSVA-ARK----IQKADREKLRRD
consensus            (858)                      XXXXXXXXXAXREXXRRX
```

Fig. 30B

| | | |
|---|---|---|
| AT4G36060.1 | (380) | KLKEQFLELGNALDPNRPKSDKASVLTDTIQMLKDVMNQV |
| LOC_Os02g23823.1 | (376) | RLNEQFQELGSTLDPDRPRNDKATILSDAIQMLKDLTSQV |
| Bradi3g11520.1 | (374) | KLNEQFQELGTTLDPDRPRNDKATILGDTIQMLKDLSSQV |
| Si017804m | (378) | KLNEQFQELGNTLDPDRPRNDKATILGDTIQMLKDLTSHV |
| GRMZM2G114444_T02 | (408) | KLNEQFQDLGNALDPDRPRNDKATILGDTIQMLKDLTTQV |
| Glyma07g26910.1 | (382) | RLNEHFQELGNALDPDRPKNDKATILTETVQMLKDLTAEV |
| POPTR_0005s11550.1 | (384) | NLNEQFLELGTTLDPDRPKNDKATILTDTIQVLKDLTAEV |
| GSVIVT01018777001 | (386) | RLNEHFLELGNTLDPDRPKNDKATILADTIQMLKDLTAEV |
| Solyc01g111130.2.1 | (406) | RLNEQFMELGKTLDPDRPKNDKASILSDTVQILKDLTAQV |
| AT3G19860.1 | (388) | KLNEHFVELGNVLDPERPKNDKATILTDTVQLLKELTSEV |
| GSVIVT01024084001 | (404) | RLNEQFTELGNALDPDRPKNDKATILSDTIQLLKDLTAQV |
| Glyma12g02740.1 | (398) | RFNVQFVELGNILDPDRPKNDKATILGDTIQLLKDLTSEV |
| Glyma08g15740.1 | (394) | RLNEQFVELGNILDPDRPKNDKATIIGDTIQLLKDLTSQV |
| Glyma15g29630.1 | (396) | RINEQFVELGNILDPDRPKNDKATILCDTIQLLKDLISQV |
| clementine0.9_014901m | (390) | RLNEHFTELGNALDPDRPKNDKATILADTVQLLKDLTSQV |
| clementine0.9_014926m | (392) | RLNEHFTELGNALDPDRPKNDKATILADTVQLLKDLTSQV |
| POPTR_0004s17540.1 | (400) | RLNEHFVELGNTLDPDRPKNDKATILADTIQLLKDLTSQV |
| POPTR_0009s13220.1 | (402) | RLNEHFVELGNTLDPDRPKNDKATILADTVQLLKDLNSKV |
| consensus | (858) | XXXXXFXXLGXXLDPXRPXXDKAXXXXXXXQXLKXXXXXV |

Fig. 30C

| | | |
|---|---|---|
| AT4G36060.1 | (380) | DRLKAEYETLSQESRELIQEKSELREEKATLKSDIEILNA |
| LOC_Os02g23823.1 | (376) | NKLKAEYTSLSEEARELTQEKNELRDEKVSLKFEVDNLNT |
| Brad13g11520.1 | (374) | NKLKAEYSSLSEEERELTQEKNELRDEKASLKSDIDNLNT |
| Si017804m | (378) | NKLKAEYTSLSEEARELTQEKNELRDEKASLKSEVDNLTN |
| GRMZM2G114444_T02 | (408) | NKLKAEYTSLSEEACELTQEKNELRDEKASLKSEVDNLNN |
| Glyma07g26910.1 | (382) | NRLKTEHKTLSEESRELMQEKNELREEKTSLKSDIENLNV |
| POPTR_0005s11550.1 | (384) | NRLKAECATLSEETHELMQEKNELREEKASLKADTENLNA |
| GSVIVT01018777001 | (386) | NRLKVECAALSEESRELVQEKNELREEKVALKSDIDNLNV |
| Solyc01g111130.2.1 | (406) | SRLKSEYAALTDESRELTQEKNDLREEKASLKSDIESLNA |
| AT3G19860.1 | (388) | NKLKSEYTALTDESRELTQEKNDLREEKTSLKSDIENLNL |
| GSVIVT01024084001 | (404) | EKLKAENASLNEESRELTQEKNDLREEKASLKSATENLNV |
| Glyma12g02740.1 | (398) | SKLKDEYATLNEESCELAQEKNELREEKASLKSDILKLNN |
| Glyma08g15740.1 | (394) | SKLKDEYATLNEESRELTQEKNDLREEKASLKSDIGNLNN |
| Glyma15g29630.1 | (396) | SKLKDEYAMLNEESRELTLEKTDLREEKASLKSDIDNLNN |
| clementine0.9_014901m | (390) | EKLKTEHAALTEESRELTQEKNDLREEKLSLRSEIENLNI |
| clementine0.9_014926m | (392) | EKLKTEHAALTEESRELTQEKNDLREEKLSLRSEIENLNI |
| POPTR_0004s17540.1 | (400) | DKLKAEYATLSEESLELTQEKNDLREEKASLKSDIENLNI |
| POPTR_0009s13220.1 | (402) | DKLKAEHAALSEESRELTLEKNDLREEKASLKSDVENLNI |
| consensus | (858, 859) | XXLKXEXXXLXXEXXELXXEKXXLRXEKXXLXXXXXXL |

Fig. 30D

```
AT4G36060.1          (380) QYQHRIKTMVPW------------VPHYSY----HIPFVA
LOC_Os02g23823.1     (376) QYQQRMRVLYPW-TGMEPSVVIGPPLPYPFSVPVPVP-VP
Bradi3g11520.1       (374) QYQQRIRMLYPW-TGMEPSVVIGPPSYPF----PVP-VP
Si017804m            (378) QYQQRMRVLYPW-AGMEPSVVIGPPPAYPY----PVP-VP
GRMZM2G114444_T02    (408) QYQQRMRVLYPW-VGMEPSVVMGPPPAYPY----PVP-VP
Glyma07g26910.1      (382) QYQQRVRIMFPW-SAIDPSAVIS--QPYSY----PVP-IH
POPTR_0005s11550.1   (384) QYHQSTRAMFPW-AAVDPSVVI---PPYSY----QVP-VP
GSVIVT01018777001    (386) QYQQRLRVMFPW-APIDPSVVMG-PSPYSY----PVP-VP
Solyc01g111130.2.1   (406) QYQQRMRTMYPW-AGMDHSMVMH-PPSYPY----PMP-VP
AT3G19860.1          (388) QYQQRLRSMSPWGAAMDHTVMMAPPPSFPY----PMP-IA
GSVIVT01024084001    (404) QYQQRLRAMFPW-SAIDPSVVVS-PPSYPF--PVPVP-VP
Glyma12g02740.1      (398) QYQQQLRTVSPW-TATDRSIMLA-PPSYPY----PVP-MP
Glyma08g15740.1      (394) QYQQQLRTMFPW-TAMDHSVMMA-PPSYPY----PVP-MA
Glyma15g29630.1      (396) QYQQQLRTMFPW-TAMEHSVMMA-PSSYPY----PVP-MA
clementine0.9_014901m (390) QYQQRVRAMVPW-AAMDHSVMMA-PPSYPY----PVP-MP
clementine0.9_014926m (392) QYQQRVRAMVPW-AAMDHSVMMA-PPSYPY----PVP-MP
POPTR_0004s17540.1   (400) QCQQRLRAPYPW-PAMDHSFMMA-PPSYPF----PMP-VP
POPTR_0009s13220.1   (402) QCQQQLRATYPW-AAMDHSVMMA-PPSYPF----PMP-VP
```

Fig. 30E

```
AT4G36060.1         (380)  ITQGQ---------------------SSFIPYSAS-
LOC_Os02g23823.1    (376)  IPSGAVPMHPQLQAYPYFRNQTSGTVSNPCTPYMAYTQP-
Bradi3g11520.1      (374)  IPTGAVPMHPQLQAYPFFRNQTLGTVPNPCTPYMAYTQP-
Si017804m           (378)  IPSGAVPMHPQLQAYPFFRSQTSGTIPNACTPYMAYTQP-
GRMZM2G114444_T02   (408)  IPSGAVPMHPQLQTYHFFHSQASGTIQNTCIPYMAYTQP-
Glyma07g26910.1     (382)  IPSAPISIHPSLQPFPFFGNQNPGHIPNPCSMYVPYTTPT
POPTR_0005s11550.1  (384)  VPPGPISMHPSLQPFVFFGNQNPGAIASPCSTFIPYPTA-
GSVIVT01018877001   (386)  VPSGPIPMHPSLQPFPFFGNQNPSGIPNPCSTFIPYQTP-
Solyc01g111130.2.1  (406)  IPTGPVPMHPPLQPYPFFGNHNPAVVPNP-SSFVQYMTP-
AT3G19860.1         (388)  MPPGSIPMHPSMPSYTYFGNQNPSMIPAPCPTYMPYMPP-
GSVIVT01024084001   (404)  IPTGSIPMHPSMQPYPFFGSQNTGIIPNPCSTFVPYFTP-
Glyma12g02740.1     (398)  IPPAPIAM----QPYPFYANQHSAIIPNPCSTFVPYLVP-
Glyma08g15740.1     (394)  VPPGPIPM----QPYPFFANQHPAVISNPCSTYVPYLAP-
Glyma15g29630.1     (396)  VPPGPIPM----QPYPFFANQHPAVISNPCSTYVPYLAP-
clementine0.9_014901m (390) MPPGAIPMHPPMQPYPMFGNQNPGVIPNPCSTFVPYMAP-
clementine0.9_014926m (392) MPPGAIPMHPPMQPYPMFGNQNPGVIPNPCSTFVPYMAP-
POPTR_0004s17540.1  (400)  MPPGAIPLHSSIQPYPFFGNQNPAVIHNPCSTFVPCMAP-
POPTR_0009s13220.1  (402)  MPPGIPMHPSMQPYPFYGNQNPAVIHNPCSTFVPYIAP-
```

Fig. 30F

```
AT4G36060.1          (380) VNPLTEQQ---ASVQQHSSSSADASMKQDSKIKPLDLDL
LOC_Os02g23823.1     (376) IHPPTDQLSNQFSAPVQHSSSNRSHSMAQDSRSKSSALQ-
Bradi3g11520.1       (374) CHP--DQPSNQFSTPVPRSSSNQSHSPAQDHRSKSCTLQ-
Si017804m            (378) CHPPTDQPSNQPNSPVANSSSHRSNSPARDCRSKSSTLQ-
GRMZM2G114444_T02    (408) CHPPTDQPSNQLNTPVAHSSSHRSNSPAQDCRSKSSTLQ-
Glyma07g26910.1      (382) SHPPVEPPSMMYAST-------SHASNQKESGSKSPGHR-
POPTR_0005s11550.1   (384) -NHPNDQPPAQYASG-------SQFSSKQDSRTKSTDHE-
GSVIVT01018777001    (386) ANPPTEVPSAQYASA-------SHVSSKPDSKSKSSDRE-
Solyc01g111130.2.1   (406) -NTLIEQQPTQYMSPIIQPGSMT----RQESRNKSSD-Q-
AT3G19860.1          (388) -NTVVEQQS---VHIPQNPGNRS-----REPRAKVS----
GSVIVT01024084001    (404) -NTLIEPQSTQHVSPPMQPGSTSNISSKQDSKNESP----
Glyma12g02740.1      (398) -NTLTEQRSTQYMSPPVHPGFRSHVSGKQESRNKSS----
Glyma08g15740.1      (394) -NTIVEQQSTQYVSPPLHPCGRSNVSGKQESKSKSS----
Glyma15g29630.1      (396) -NTIVEQQSTLYVSPPLHPGARPNVSGKQESKSKSS----
clementine0.9_014901m (390) -NTLVEQQSAQYASAVAQPSGRSQGSAKEDSGNKSS----
clementine0.9_014926m (392) -NTLVEQQSAQYASAVAQPSGRSQGSAKEDSGNKSS----
POPTR_0004s17540.1   (400) -NTLVDQQSAQHVSSLSQPASRSHVSGEQDLKNKPS----
POPTR_0009s13220.1   (402) -NTLFDQQSAQHVSSLAQSASRSHVSVKQDSKNKSS----
```

Fig. 30G

```
AT4G36060.1          (380) MMNSNHSGQGNDQKDDVRLKLELKIHASSLA---------
LOC_Os02g23823.1     (376) ---QVSCRGKHDDFDDVATDLELKTPGSSAPLQSEIAN--
Bradi3g11520.1       (374) ---QTSCGRRSDDFGDVATDLELKTPGSSAPSHSEIAK--
Si017804m            (378) ---QASCGVRSSDVGDVATDLELKTPGSSGPSHSEIAN--
GRMZM2G114444_T02    (408) ---QPSCGVRSSDAGDIATDLELKTPGSSCQSHAEIAY--
Glyma07g26910.1      (382) ---RSSGAERSSETDDVVTELELKMPGSSSTQ--------
POPTR_0005s11550.1   (384) ---GGRNKERCNDSSDVATDLELKMPGSSAQ---------
GSVIVT01018777001    (386) ---RSSNTEKCDESNDVATDLELKTPGSSSQ---------
Solyc01g111130.2.1   (406) ---GESRIEKSEDSNEVATDLELKTPGSTSE---------
AT3G19860.1          (388) ---RESRSEKAEDSNEVATQLELKTPGSTSD---------
GSVIVT01024084001    (404) ---GESKSEKGEDSTDVATDLQLKTPGSKSD---------
Glyma12g02740.1      (398) ---KESKAEKHEDSNDVTLT-----PGSSAD---------
Glyma08g15740.1      (394) ---RESKAEKNEDSNDVTTDLELKTPGSSAD---------
Glyma15g29630.1      (396) ---RESMAEKNEESNDVTTDLELKTPGSSADQVSVVFQGY
clementine0.9_014901m (390) ---GESKIEKNEDSNNVTTDLELKTPGSTTD---------
clementine0.9_014926m (392) ---GESKIEKNEDSNNVTTDLELKTPGSTTD---------
POPTR_0004s17540.1   (400) ---GECKIEKSEGSNDVTTDLELKTPGSTAD---------
POPTR_0009s13220.1   (402) ---GESKVEKSKDSNDVTTDLELKTPGSTAD---------
```

Fig. 30H

```
AT4G36060.1           (380) ----------------QQDVSGKE---------KKVSLT
LOC_Os02g23823.1      (376) ----------------KDSSSDLKKKQQFIQETKGSSLT
Bradi3g11520.1        (374) ----------------KDSSSDLKKKKQCINQINGSILT
Si017804m             (378) ----------------KDSSSDLKTKKQCIKQINCSSIT
GRMZM2G114444_T02     (408) ----------------NDSSSDLKTKKHCIKQINDCTLT
Glyma07g26910.1       (382) ----------------QGCTSGGR-----KGKMKDRTII
POPTR_0005s11550.1    (384) ---------------------------------------
GSVIVT01018777001     (386) ----------------QDLLTGEK--KGKQSQRKERSAT
Solyc01g111130.2.1    (406) ----------------QDLSSGQK--KSRKLPRKDNSFT
AT3G19860.1           (388) ----------------KDTLQRPEKTKRCKRNNNNNSIE
GSVIVT01024084001     (404) ----------------QEVSSGQQQHKPKRSLSKEKNST
Glyma12g02740.1       (398) ----------------QDLSSGQR--KSSKLSRKESSCT
Glyma08g15740.1       (394) ------------------------QVSVVFQGYPMIE
Glyma15g29630.1       (396) PMIEDASDSSCVCVSGLQDLSSGQR--KSSKLSRRESSCT
clementine0.9_014901m (390) ----------------QDLPSGQR--KSKKSLRKENSFT
clementine0.9_014926m (392) ----------------QDLPSGQR--KSKKSLRKENSFT
POPTR_0004s17540.1    (400) ----------------QDLSSGQR--KSKKSQRKESSVT
POPTR_0009s13220.1    (402) ----------------QDLTSVQR--KSKKSTGKESSVT
```

Fig. 30I

```
AT4G36060.1           (380)  TTASSSNSYSLSQA--VQD-SSPGTVNDMLKP---------
LOC_Os02g23823.1      (376)  EGSSSSSRC-SSSG--PPD--VSNSIEGGSVADDQRSTVQ
Bradi3g11520.1        (374)  EG-SSSSRC-SSSG--PPD--VSNSVGDGSVPDDQ-----
Sl017804m             (378)  EG-TSSSRC-SSSG--PPD--VSNSVGDG-----------
GRMZM2G114444_T02     (408)  ES-SSSSRC-SSNG--PPD--VSNSAIDE-----------
Glyma07g26910.1       (382)  GG-SASSQYSSSLG--LQD--SSNSVGDIPKTDN------
POPTR_0005s11550.1    (384)  ----------------------QVHSEVIRH---------
GSVIVT01018777001     (386)  DG-SCSSKYSSSQA--LQD-SSSNSVGDLPKSDK------
Solyc01g111130.2.1    (406)  DG-SSSSKCSSSHS--VHA-VSSNSVVRGTKTGD------
AT3G19860.1           (388)  ES-SHSSKCSSSPS--VRDHSSSSSVAGGQKPDDAK----
GSVIVT01024084001     (404)  EG-SSSSRCSSSPS--VQD-SSSNSVVGGRKADD------
Glyma12g02740.1       (398)  EV-SSLDRCSLSCS--VQD-SSSSSVVHKHKG--------
Glyma08g15740.1       (394)  DALDSSCVCLWFAGFIIQTKKIQQVVKEGKQLHRRKFIR
Glyma15g29630.1       (396)  EW-SSLGRC-SSCS--VQD-SSSSSVVASRKDNE------
clementine0.9_014901m (390)  NG-SSSSRCSSSRS--VQD-SSSNSVAGGRKADDLG----
clementine0.9_014926m (392)  NG-SSSSRCSSSRS--VQD-SSSNSVAGGRKADDLG----
POPTR_0004s17540.1    (400)  ER-SSSSRCSSSHS--VQD-SSSNSVVDSTKHDDLDKLE-
POPTR_0009s13220.1    (402)  KE-SSSSRCSSSHS--VQD-SSSNSVVGNTKVDDLDKREN
```

Fig. 30J

```
AT4G36060.1              (380) -
LOC_Os02g23823.1         (376) T
Bradi3g11520.1           (374) -
Si017804m                (378) -
GRMZM2G114444_T02        (408) -
Glyma07g26910.1          (382) -
POPTR_0005s11550.1       (384) -
GSVIVT01018777001        (386) -
Solyc01g111130.2.1       (406) -
AT3G19860.1              (388) -
GSVIVT01024084001        (404) -
Glyma12g02740.1          (398) -
Glyma08g15740.1          (394) -
Glyma15g29630.1          (396) -
clementine0.9_014901m    (390) -
clementine0.9_014926m    (392) -
POPTR_0004s17540.1       (400) -
POPTR_0009s13220.1       (402) -
```

Fig. 30K

```
AT1G60250.1         (410) --------MAQVCHTCRHVTAVIHCVTEALNFCLTCDNL
AT1G68190.1         (412) MLCIIIIENMERVCEFCKAYRAVVYCIADTANLCLTCDAK
Solyc04g007470.2    (420) --------MEMEKACEFCMLLKPVVYCEADAAHLCLSCDAK
POPTR_0008s12410.1  (414) --------MEKVCEFCMALRPVVYCNADAAYLCLSCDAK
Glyma10g41540.1     (416) --------MEKVCEFCTALRPLVYCKADAAYLCLSCDAK
Glyma20g25700.1     (418) --------MEKVCEFCTALRPLVYCKADAAYLCLSCDSK
consensus           (860)             CXXCXXXXXXXXCXXXXXXCLXCDXX AT1G60250.1         (410) RHH-NNTHAEHVRYQLCDNCSMYPSILFCYEDGMVLCQSC
AT1G68190.1         (412) VHSANSLSGRHLRTVLCDSCKNQPCVVRCFDHKMFLCHGC
Solyc04g007470.2    (420) VHSANALSNRHPRTLVCECCGHNPAYIRCSDHQTFMCRDC
POPTR_0008s12410.1  (414) VHSANALFNRHLRTLLCDSCRNHPAYAQCLDHRMLMCLGC
Glyma10g41540.1     (416) VHLANAVSGRHLRNLVCNSCGYHLAYVLCLEHKMLICRDC
Glyma20g25700.1     (418) VHLANAVSGRHLRNFVCHSCGYHLAYVLCLEHKMLICRDC
consensus           (860) XHXXNXXXXXH AT1G60250.1         (410) YSHHYNCATNGHQTQVVFANMNNQH-HDHAHMPHVVHHNN
AT1G68190.1         (412) NDKFHGGGSSEHRRRDLRCYTGCPPAKDFAVMWGPRVMDD
Solyc04g007470.2    (420) DRCHHDLSSQ-HQRKVITSYMGSPSAKDLAALWGPGLKDL
POPTR_0008s12410.1  (414) DRCLHEVSSH-HQKRLVSSYLGCPSAKDFASLWGFEFGDL
Glyma10g41540.1     (416) DQKLHNISLP-HKKRAIRSFMGCPSAKDFAALWGVELNEI
Glyma20g25700.1     (418) DQKLHNISLP-HKKRAIRSFMGCPSAKDFAALWGFESNEI
```

Fig. 33A

```
AT1G60250.1          (410) NNNHQQQHV---------------GGHQRRAEMFE--
AT1G68190.1          (412) DDDVSLEQ-----------------------SFRMVK--
Solyc04g007470.2     (420) ENATPPDQFISTSN---------GKANGVKVISKKFK--
POPTR_0008s12410.1   (414) DKSIVKDQLVSTPC---------SSSVQPSASKFDIP
Glyma10g41540.1      (416) ENSASQDQFDSVSCVSADLNVAQVSGKPGIQTEVPSML--
Glyma20g25700.1      (418) ENNLNVAQV--------------SGKPGIQTGIPSMP--

AT1G60250.1          (410) -RSCHGDNN-------------------------------
AT1G68190.1          (412) -PKVQREGG-------------------------------
Solyc04g007470.2     (420) -RSHSSPGGSSLASELDFTGLVVSPESEVGSTSYYTKVLS
POPTR_0008s12410.1   (414) GKSCQQIGRSSRKSRVIHSTLVSGAESDVGSGNQRPELSY
Glyma10g41540.1      (416) -SGAKLDGG-----------------------GSTSQQGQILY
Glyma20g25700.1      (418) -SGAKFDGG-----------------------GSTSQQGQILY AT1G60250.1          (410) ----------------------------------------
AT1G68190.1          (412) ----------FILEQILELEKVQLREENGSSSLIERGD---
Solyc04g007470.2     (420) LRKRRENTSLILQQILDLERLQLTE--GSNNLTSGESRNN
POPTR_0008s12410.1   (414) KGPQQESTCFILEQILDLKRLQLTDVNNWTPMKRGQEQKN
Glyma10g41540.1      (416) SDQKRQ---TILQQIIDFKWLQQNEEIDYSAKINRLQEKD
Glyma20g25700.1      (418) SDQERQ---TILQQIIDLKMLQQNEDIDYLAKINRLQEKD
```

Fig. 33B

```
AT1G60250.1          (410)  ------CERWMFAMRCELCVASNSNAVVY-----CPTHNQ
AT1G68190.1          (412)  --PSPLELPKKPEEQLIDLPQTGKELVVDFSHLSSSSTL-
Solyc04g007470.2     (420)  VSSLKNCTSWNMHNKFD-CLQSSLDLGPELQDWGSTHESP
POPTR_0008s12410.1   (414)  I-----STSKKLDYNLN-HSQHSQDLVTILQQADCQRQGL
Glyma10g41540.1      (416)  SSPSVYQTLKKLDDKFNEQAQNSQDLATNVLEKDCPIMEL
Glyma20g25700.1      (418)  LSPSVYHTLKKLDDKFNEQAQKSQDLATNVLEKDCPTVEL AT1G60250.1          (410)  IL-------------------------CDS-----
AT1G68190.1          (412)  -----------------------GDSFWECKSPYNKN
Solyc04g007470.2     (420)  VDESFPLPLPD------------GDSFWECKSPV-QS
POPTR_0008s12410.1   (414)  KVDSLPLPFSQPEHLPFFSTAANALPGESFWPCKSPI-EN
Glyma10g41540.1      (416)  NPETLPSTFSQLDNLYSSSTIDLPHGELFWTCKSPL-QS
Glyma20g25700.1      (418)  NPETLPSTFSQFDNLYSSSTIDLPHGELFWTCRSPL-QS AT1G60250.1          (410)  ------------CDRMIHSHEDAVPPHSRCKLC------
AT1G68190.1          (412)  NQLWHQNIQDIGVCEDTICSDDFQIPDIDLTFRNFEEQF
Solyc04g007470.2     (420)  SQLWPQNLQDLGAYAELERF-DNSNMPDVDLTFQNFEELF
POPTR_0008s12410.1   (414)  SQLWSQNMQDLGVCEDIICHDDDYIIPDVDKTFCNFEEFF
Glyma10g41540.1      (416)  NQLWSQNIQDLGICKELVCQ-DDFNIPDVDLTFQNYEELF
Glyma20g25700.1      (418)  NQLWSQNIQDLGICKELVCQ-DDFNIPDVDLTFQNFEELF
```

Fig. 33C

```
AT1G60250.1          (410) ---------------VICKRPSRRFLIGGYQFNFP-PVHP
AT1G68190.1          (412) GADPEPIADSNNVFFVSSLDKSHEMKTFSSSFNNPIFAPK
Solyc04g007470.2     (420) GEDQYLNNTLLEE-DMTCSSMENDSSIDRSDYS---YVKK
POPTR_0008s12410.1   (414) GGDQDPIGAFLDENDFSCSFIEKDMPPEKSNNSDG-RARK
Glyma10g41540.1      (416) GGDQDPIRILLDDQDVSCSSLEKDKSVDKSVIDNP-SAME
Glyma20g25700.1      (418) GGDQDSIRILLDDQDVSCSSLEKDKSVGKSDIDNP-SAME AT1G60250.1          (410) PAAEGIPVT-PPTELPQQDIN-------------------
AT1G68190.1          (412) PASSTISFSSSETDNPYSHSEEVISFC-------------
Solyc04g007470.2     (420) DISTASSVRTGHSTHFGQAHGEHI-----PTIKDCPPPIR
POPTR_0008s12410.1   (414) DASVTSSVYISCSVHIDNDKDPSNQAYNFPGSLDPAQTIR
Glyma10g41540.1      (416) ESSAAASITISQSDLDNKDMNPLSQYC--PRSMDPAHAIR
Glyma20g25700.1      (418) ESSAAASITISQSDLDNKDMNPLSQYR--PRSMDPALAIR AT1G60250.1          (410) ------------------YDYLDD----------------
AT1G68190.1          (412) ----------PSLSNNTRQKVITRLKEK------------
Solyc04g007470.2     (420) TNFSS-LSFSASRLSSESSGNEYVDSPAANDQEVSCNSQM
POPTR_0008s12410.1   (414) SPYSR---YSISSHDAESRSNEYLDSEL---------SPY
Glyma10g41540.1      (416) -PFDSTIPFSVLRFNEESSCTNHDDSAL---------SPY
Glyma20g25700.1      (418) -PFDSTIPFSVLRFNEESSCTSHDDSAL---------SPY
```

Fig. 33D

```
AT1G60250.1       (410)  ---VDDFSWFGR-------------------------
AT1G68190.1       (412)  ---KRARVEEKKA------------------------
Solyc04g007470.2  (420)  DSKKKARLYEKQARNTPRRARTNFKKQHVLKAHCYETDAL
POPTR_0008s12410.1(414)  ISNGEASCYSPDLEDAHTEARENAKRLG---------
Glyma10g41540.1   (416)  ---SEGRAYSGS-------------------------
Glyma20g25700.1   (418)  ---SERKAYSGS-------------------------

AT1G60250.1       (410)  ------
AT1G68190.1       (412)  ------
Solyc04g007470.2  (420)  NMSRSF
POPTR_0008s12410.1(414)  ------
Glyma10g41540.1   (416)  ------
Glyma20g25700.1   (418)  ------
```

Fig. 33E

```
Glyma04g42270.1       (456)  -MALGKNSRGE--GRKL------SNYCSTVS-VAVFVAFC
Glyma06g12540.1       (458)  -MALGKNSQGK--GRKL------SNYCSTVS-VAVFVAFC
Solyc04g063230.2.1    (462)  -MAGESYSHSG--GRKS------SDFCSKLT-VVTFLGIS
AT1G29470.1           (444)  -MAMGKYSRVD--GKKS------SGYGLTIT-IVLIVSLC
AT2G34300.1           (446)  -MAMGKYSRVD--GKKS------SSYGLTIT-IVLLLSLC
Bradi4g23610.1        (438)  MALFDRNQR----GQRS------SLFSTAT-IVLFVALC
LOC_Os11g08314.1      (440)  MALFDRNQK-----QRS------SLCSTAT-VVVFVALC
Si028042m             (442)  MALFDRNQR-----QRS------SFCSTATFFVAFVALC
LOC_Os01g66110.1      (424)  -MAFGRGSKMD--GRRS---SPSSSLCTTTI-VVVFVALC
Bradi2g57087.1        (422)  -MAFGRGAKMD--GRRP--SSPSSSLCTTTI-VVVFVALC
GRMZM2G049269_T01     (426)  -MAFGRGGKMD--GRRPSSSSSSSSFCTTTI-VVLFVALC
Si000354m             (428)  -MAFGRGAKMD--GRRP--SSSSSSFCTTTI-VVVFVALC
Bradi5g27590.1        (430)  -MALG-HTRLD--VRRL--QQHSSSYCSATT-VVVFVALC
LOC_Os04g59590.1      (432)  -MAFGSHTRLD--VRRA---QQHSSFCSPSSAAAVLVALA
GRMZM2G002642_T02     (434)  -MPFG-HTRLD--VRRP--PQSSYLCCSTTT-VAVFVALC
Si021320m             (436)  -MAFG-HTRLD--ARRP----PQSSYCSCST-ATIVVALC
AT5G64030.1           (464)  -MAQPRYTRID--NRRP------SSNYCSTVT-VVVFVALC
Solyc05g056580.2.1    (476)  -MALGKYSRVD--GRKS------SNYCSTVT-IVVFVALC
Glyma05g32670.1       (472)  -MAQAKYTRID--NNKRP-----SSYCSTVT-IVVFVALC
Glyma08g00320.1       (474)  -MAQAKYTRIDNNNKRP------SSYCSTVT-IVVFVALC
Glyma04g38870.1       (468)  -MALGKYARVD--GRRS------SSWCSTVT-VVMFVALC
Glyma06g16050.1       (470)  -MALGKYARVD--GRRS------SSWCSTVT-VVVFVALC
```

Fig. 36A

```
Glyma04g42270.1      (456) LVGVWIV--MSSIVPIQNSVIQVSETDTI-----------
Glyma06g12540.1      (458) LVGVWIV--LSSIVPIQNSVIQVSETETIN-----------
Solyc04g063230.2.1   (462) CIGIWML ISSSFSITLQNSEISSTNI-----------
AT1G29470.1          (444) LVGAWMF-MSSWSAPTESIDFSANERTKDVDTT--------
AT2G34300.1          (446) LVGTWMF-MSSWSAPADSAGYSSTDTAKDVSKN--------
Bradi4g23610.1       (438) LVGFWMV-STPSAPPEALPTTTASAAAEVVKK---------
LOC_Os11g08314.1     (440) LVGLWMI-SSPETIPAAAANVSKKPDVVAVKEEDSSLDAT
Si028042m            (442) LLGLWMA-AVKADAKEEDSSIDATNTVKQDSA---------
LOC_Os01g66110.1     (424) LVGAWMM-TSSTIFPLEITSNKKAAVKEQPARV--------
Bradi2g57087.1       (422) LVGAWMM-TSSTVFPLEKPEVRDQRAAVDFGAT--------
GRMZM2G049269_T01    (426) LVGAWMM-TSSTVFPLEISSNKKPVVKQQPAPV--------
Si000354m            (428) LVGAWMM-TSSTVFPLEISSNKKSVVKQQPAPV--------
Bradi5g27590.1       (430) LVGVWMA-SSMLVTPADFSPFQPSLPRRPVAT---------
LOC_Os04g59590.1     (432) LVAVWMA-SSTLVTPADFSPFRP------------------
GRMZM2G002642_T02    (434) LVAVWMA-SSMLVTPAEFPPFQSKVR---------------
Si021320m            (436) LVAVWMA-STMLVTPAEFPPFQPKVRPLAPH----------
AT5G64030.1          (464) LVGIWMM-TSSSVGPAQNVDEVSLDNKDGIKKQ--------
Solyc05g056580.2.1   (476) LVGVWMM-TSSSVVPDQNLDLSSQGKKTDLSTQVTEGKES
Glyma05g32670.1      (472) LFGIWMM-TSSSVTPVQNVDVSQENNSEVKE----------
Glyma08g00320.1      (474) LFGIWMM-TSSSVTPVQNVDVSQENNNEVKEQS--------
Glyma04g38870.1      (468) LVGVWMM-TSSSVVPVRNGDEAQENKNQVKEQA--------
Glyma06g16050.1      (470) LVGVWMM-TSSSVVPVRNGDEAQENKNQVKEQT--------
```

Fig. 36B

```
Glyma04g42270.1     (456) ---------------NDVKNVASDSKQFEDRSGDISEESTQG
Glyma06g12540.1     (458) ---------------DDVKNVASDSKQFED-----------
Solyc04g063230.2.1  (462) ------------------LGQYSGSSADFLVNTKRG
AT1G29470.1         (444) ----------KSDFKSEEVDRGSKSFPD---------EKN
AT2G34300.1         (446) ----------DLRKEEGDRDPKNFSD-----------EKN
Bradi4g23610.1      (438) ----ADAAGAAKEKEEDSSIDATNNFKQDSTNVVAAEVVA
LOC_Os11g08314.1    (440) NNVKQNSANVV--AETAAADEAAAADEDDNPAKPAAGEKA
Si028042m           (442) ------------NVVAETTAAAEASQEDPAKPAAEDAKG
LOC_Os01g66110.1    (424) ----NYGASEEAAAASGNSAEGVDRFGD---------TDN
Bradi2g57087.1      (422) ----EE-------SPSGNAGGSSAKFED---------TDN
GRMZM2G049269_T01   (426) ----NFGASQE--ASPGIAGEGSEKFED---------TDN
Si000354m           (428) ----NFGASED--AASGNAGESSGKFED---------TDN
Bradi5g27590.1      (430) ----------------------------------------
LOC_Os04g59590.1    (432) ----------------------------------------
GRMZM2G002642_T02   (434) ----------------------------------------
Si021320m           (436) ------------DSPPATGGLTNA----------------
AT5G64030.1         (464) ------------MTPPAEEGNGQKFEDAPVETPNEDKKG
Solyc05g056580.2.1  (476) YNGGNESNNKAGDESNPTDEGKSKQFEDTLGDLPEDATKG
Glyma05g32670.1     (472) -------------QATDPSNNSQQFEDNRGDLSEDATKG
Glyma08g00320.1     (474) ---------EAKEQPTDPSNNSQQFEDNRGDLSEDATKG
Glyma04g38870.1     (468) ----EVKE-----AVSEVSNSNTRQFEDNPGDLPEDATKG
Glyma06g16050.1     (470) -------EPTEVKEAVSEVSNSNMRQFEDNPGDLPEDATKG
```

Fig. 36C

```
Glyma04g42270.1      (456)  DSQ------TKKSQSGDSHPENLDDQKGIEKVSDNTEEENQ
Glyma06g12540.1      (458)  --------RSENQDDQKGIEKVSDNTAEENQEV--------
Solyc04g063230.2.1   (462)  EDETFQ--GEKRFRRGRYLEEIGDEKGLDSYQN--------
AT1G29470.1          (444)  EETEV---VTETNEEKTDPEKSGEENSGE------------
AT2G34300.1          (446)  EENEA---ATENNQVKTDSENSAEGNQVNESSGE-------
Bradi4g23610.1       (438)  TNAETNN-PDNGGGGDGDKAASFDDENGRTEGG--------
LOC_Os11g08314.1     (440)  AAAA----ASSKDQTFDDENGRTEGGALVKPESGGGDEAA
Si028042m            (442)  DGDKA---AASKDQTFDDENGRTEGGELVKPGNGGET----
LOC_Os01g66110.1     (424)  NDNAV---PEEPNNTVPSEEEKFSENTVEKPVESSE-----
Bradi2g57087.1       (422)  NDNVP---DESHNNRDAPEEEKFTEDTMEKPVERTE-----
GRMZM2G049269_T01    (426)  NDATV---PEEPNKQDASEQENFNEKPEEK-----------
Si000354m            (428)  NDTTV---PEESNNKEAPEEEKFTENMAEKPEEK-------
Bradi5g27590.1       (430)  --------PAKGDSRPVVREESAEEKPEDAV----------
LOC_Os04g59590.1     (432)  --------TTTTTTTTARPRNRMDPVTVEEDA---------
GRMZM2G002642_T02    (434)  --------PLRPHDSPPATGSLTSADQGDGITT--------
Si021320m            (436)  --------GEDDATGEMERDVPLDPVPAEGTTTT-------
AT5G64030.1          (464)  DGDASLPKEDESSSKQDNQEEKKEEKTKEEFTPSSETKS-
Solyc05g056580.2.1   (476)  DALVS---QEENVSNPQQTESTSEVKQEEKSTEQKE-----
Glyma05g32670.1      (472)  DGSVT---PDKNSDVKEKQEEKSDEKSQEKPSEDTKTENQ
Glyma08g00320.1      (474)  DGSVT---PATNYDVTEKQDEKSDEKSQEKPSEDTKTENQ
Glyma04g38870.1      (468)  DSNV----TFEDNSNSSDKQEKLEENPVERSSDDTKTE--
Glyma06g16050.1      (470)  DSNVA---SEDNSNLSDKQEEKSEENPVERSSDDTKSE--
```

Fig. 36D

```
Glyma04g42270.1     (456) EA-------VGDNSDEKNDLEEGLGNTIEENDQMRNVKPS
Glyma06g12540.1     (458) ---------VGDNSDEKNDLEKGLENTIEENDQMRNVKPS
Solyc04g063230.2.1  (462) ---------EEREGESSNLRNEEENQENSESSPSGDESQS
AT1G29470.1         (444) ---------KTESAEERKEFDDKNGDGDRKNGDGEKDTES
AT2G34300.1         (446) ---------KTEAGEERKESDDNNGDGDGEKEKNVKEVGS
Bradi4g23610.1      (438) ---------ELVKPETTADADSAAAAAVAARKTVDDTTT
LOC_Os11g08314.1    (440) SDVKEIGSLEQAAIDMKDTTEHSVGDTTKEPGVVQDKSSE
Si028042m           (442) ---------DAAAAQGKGAAEEASAETDGKDAGGMDQAST
LOC_Os01g66110.1    (424) ---------EKAPPKEKEESKDTFDDANGKTEQSSAKEDG
Bradi2g57087.1      (422) ---------EKEAPKEKDEVKDSFDDANGKSEVKNSKEGG
GRMZM2G049269_T01   (426) ---------ELEVPVEKAETKDMFDDANGKSEGLSDETK-
Si000354m           (428) ---------EQEPPREREENKDMFDDANGKSEGRSDDVKN
Bradi5g27590.1      (430) ---------PADEATEKTTNQPGEQQSVPELKEKLDEEQE
LOC_Os04g59590.1    (432) ---------DDPPPLTLRQTETGPGGDNGSHSHSPSL---
GRMZM2G002642_T02   (434) ---------HDDPPPATQQLPPVTDSMDGENQ--------
Si021320m           (436) ---------DDDPPPVTEQVPPVTKDAATESSTDGPQQNV
AT5G64030.1         (464) ---------ETEGGEDQKDDSKSENGGGGDLDEKKDLKDN
Solyc05g056580.2.1  (476) ---------DAGESESETQSEKATDGSDDKKEDGPNKVDD
Glyma05g32670.1     (472) DTSVSEKRSDSDESQQKSDSDESQQKSDSDESEKKSDSAE
Glyma08g00320.1     (474) DSSVSEKRSDSDESEKRSDSDESEKKSDSDESEKKSDSDE
Glyma04g38870.1     (468) ---------DVDDKKTEEEGSNTENESNSDSVENNKDSDE
Glyma06g16050.1     (470) ---------DVEDKKTEEEGSNTENESNSDSTENSKDSDE
```

Fig. 36E

```
Glyma04g42270.1      (456)  T--DEKEKESDGSLNSESKETSNDQIHDDELKGSMETLDE
Glyma06g12540.1      (458)  TDETEKESDRSLNSESEETETSNDQIHDDELRGSMETLDE
Solyc04g063230.2.1   (462)  G--------------DESSNRESEEVDSRE----------
AT1G29470.1          (444)  E---------------SDETKQKEKTQ-------------
AT2G34300.1          (446)  E---------------SDETTQKEKTQ-------------
Bradi4g23610.1       (438)  AKDGEKTSGDTKNSDESTVSAASKKQTFDDENGKMEGVDV
LOC_Os11g08314.1     (440)  EITMAASDARESSDGGGGGGAAKNKQTFDDENGKLDGVNL
Si028042m            (442)  D-------------AKDQSAEQASTDTKESAEQAAAAVAGRG
LOC_Os01g66110.1     (424)  D---------------SESGSGQSDGSKNGD---------
Bradi2g57087.1       (422)  E-----------TGRSGDEEGKDNETTEND----------
GRMZM2G049269_T01    (426)  ----------------NDDGEKSVEKKDNEI---------
Si000354m            (428)  D---------------NDDGDKSEEKKDDEI---------
Bradi5g27590.1       (430)  A---------------KKKGDKPHEQNVF-----------
LOC_Os04g59590.1     (432)  ----------------------------------------
GRMZM2G002642_T02    (434)  ----------------------------------------
Si021320m            (436)  R---------------------------------------
AT5G64030.1          (464)  S--------DEENPDTNEKQTKPETEDNEL----GEDGEN
Solyc05g056580.2.1   (476)  K-------------DSEAGEKTENKSVGEE----------
Glyma05g32670.1      (472)  SEKKSDSDESEKKSDSDETEKSSESNDNKQ----FDSDER
Glyma08g00320.1      (474)  SEKKSDSDESEKKSDSDESEKKSEYNETEKNSESNDSSER
Glyma04g38870.1      (468)  T--------STKESDSDESEKKPDSDDNKK----------
Glyma06g16050.1      (470)  T--------STKESDSDENEKKSDSDESEK----------
```

Fig. 36F

| | | |
|---|---|---|
| Glyma04g42270.1 | (456) | KESDKSANDNKLGTEKSKGEVTQQDEMVGETEEEKIKKNL |
| Glyma06g12540.1 | (458) | KESDKSTNDNKLGTEKSMDEA--TQQDEMVGETAEDKKHL |
| Solyc04g063230.2.1 | (462) | ---KDSTSGD---------------GESDTGGEDSNLDASE- |
| AT1G29470.1 | (444) | ---LEESSEENKSEDSN------GTEENAGESEENTEKKS |
| AT2G34300.1 | (446) | ---LEESTEENKSEDGN------GNEEKAEENA------- |
| Bradi4g23610.1 | (438) | VKDDAGANNSNKTPISED------ITVKPIADESSTAAEAK |
| LOC_Os11g08314.1 | (440) | VKDVENKTMSEE-----------GAKPLPEETTTVSSKNS |
| Si028042m | (442) | TPKNLTFDDENGKMDGVDLVKDDGNKTRISEESAKVEGAA |
| LOC_Os01g66110.1 | (424) | ---DEEKSEEKKDDEQSDGERKDDQEEKAEGSGSKDTTDQ |
| Bradi2g57087.1 | (422) | ---VDQFNGEKKE-----------DQEGKSGDDAMQDATEQ |
| GRMZM2G049269_T01 | (426) | ---TNESGDEKTDGESKD------GQEEKPDGDAAQEEQPK |
| Si000354m | (428) | ---TNESGDEKPDGERKD------DREEKSEGDATQEEQPQ |
| Bradi5g27590.1 | (430) | ---------------------------------------- |
| LOC_Os04g59590.1 | (432) | ---------------------------------------- |
| GRMZM2G002642_T02 | (434) | ---------------------------------------- |
| Si021320m | (436) | ----------------------EQVKQPDEQSASKLKEK |
| AT5G64030.1 | (464) | QKQFESDNGEKKSIDDDKKSSDDDKENKTGNEDTETKTEK |
| Solyc05g056580.2.1 | (476) | ---IKEGSDEKKSIENSV-----ELNDKKDQEVGQSSDE- |
| Glyma05g32670.1 | (472) | ENKSDSDENEKKSGDASETTD--KTEEKVEQSGNQESDEN |
| Glyma08g00320.1 | (474) | ENKSDSDENEKKSDDASETTD--KTEEKVEQSSNQESDEN |
| Glyma04g38870.1 | (468) | ---SDSDESEKQSDDSDE-----TTNTRIEEK-------- |
| Glyma06g16050.1 | (470) | ---QSNDTDETTDT---------KIEEKVEESDNKESDEN |

Fig. 36G

```
Glyma04g42270.1      (456) HSETTQSTGGSNTESHENNPALKEVSITGTPSETLIETST
Glyma06g12540.1      (458) HSEATQSTGGSNTESHENNPASKEILVTGTSSEILIETST
Solyc04g063230.2.1   (462) ----------TTEKAKKGETENEVFPAADQSEILKEATT
AT1G29470.1          (444) EEN--------AGETEESTEKSKDVFPAGDQAEITKESST
AT2G34300.1          (446) -----------SETEESTEKSSKEVFPAGDQAEITKESST
Bradi4g23610.1       (438) LTSSDSTGEQQALQEEDQMNLLPEALPNG-QAELLTERAA
LOC_Os11g08314.1     (440) IVAAAAMSDEKLTDNNGEQAQPVEALPNG-QAELLTERAA
Si028042m            (442) LTVKPLAKAA-AATTDTDTTSTAEALPNV-QAELLTERAA
LOC_Os01g66110.1     (424) PQIEETVD---ESGEKGQGAKSNEVFPDGAQSELLKESNT
Bradi2g57087.1       (422) PQIEEKVE---ESGEKEQAAKANEVFPDAAQSELLKESNT
GRMZM2G049269_T01    (426) IEENVE-----ENGEKDQSSNSNEVFPDGAQSELLKESNT
Si000354m            (428) IEEKVEE----SGEKKEQSSNSNEVFPDGAESELLKESNT
Bradi5g27590.1       (430) ----------KPDVEQEAKKEAEVFPDASQAELLYETAT
LOC_Os04g59590.1     (432) ---------------------------------ETAT
GRMZM2G002642_T02    (434) -----------------------------QQELF---TT
Si021320m            (436) LN--------ENKQAPKEDKPTEVFPDGSQAELLNETTT
AT5G64030.1          (464) ENTETNVDVQVEQEGQSKNETSGDLSPPGAQLELLNETTA
Solyc05g056580.2.1   (476) ----------KSDGEKKDLSSSAVLSSGTQSDLLNETT
Glyma05g32670.1      (472) SNEK------KTDDNANSQGSNEVYPSVAQSELLNESTT
Glyma08g00320.1      (474) SNEK------KTDDNANSQGSNEVYPSVAQSELLNESTT
Glyma04g38870.1      (468) ----------NTNDDTKQKTSKEVYPSGAQSELHEESTT
Glyma06g16050.1      (470) SSEK------NINDDTKQKSSKEVYPSGAQSELQEESTA
```

Fig. 36H

```
Glyma04g42270.1      (456) ENGTWSTQAAESQHEK-------------------
Glyma06g12540.1      (458) ENGTWSTQAAESQHEK-------------------
Solyc04g063230.2.1   (462) QNGPWSTQAAESEKEN-------------------
AT1G29470.1          (444) GSGAWSTQLVESQNEK-------------------
AT2G34300.1          (446) GDGAWSTQLVESQNEK-------------------
Bradi4g23610.1       (438) QNGSFTTQADESTNEKNKRAAELKNSTTKKTKKKKAKKPK
LOC_Os11g08314.1     (440) QNGSFTTQAAESIKEK---------------KKRAEKKKK
Si028042m            (442) QNGSFTTQAAESTEEK---------------KKRAGAEK-
LOC_Os01g66110.1     (424) ENGSFKTQDAESKNEK-------------------
Bradi2g57087.1       (422) ENGSFSTQAAESKKEK-------------------
GRMZM2G049269_T01    (426) QNGSFPTQAAESKNEK-------------------
Si000354m            (428) QNGSFPTQAAESKNEK-------------------
Bradi5g27590.1       (430) EPGPWRTQAAESNMET-------------------
LOC_Os04g59590.1     (432) EADPQAAQSNSNTKDT-------------------
GRMZM2G002642_T02    (434) ERGPWSTKAEQSNKDA-------------------
Si021320m            (436) ERGPWPTQAAQSNKDT-------------------
AT5G64030.1          (464) QNGSFSTQATESKNEK-------------------
Solyc05g056580.2.1   (476) QNGAFLTQASESKNEK-------------------
Glyma05g32670.1      (472) QNGSFTTQAAESKNEK-------------------
Glyma08g00320.1      (474) QNGSFTTQAAESKNEK-------------------
Glyma04g38870.1      (468) ETGSWSTQAAESKNEK-------------------
Glyma06g16050.1      (470) ETGSWSTQAAQSKNEK-------------------
```

Fig. 36I

```
Glyma04g42270.1      (456) -------------ESQKSSVSIDSRTYDWKLCNTTTGSEYI
Glyma06g12540.1      (458) -------------ESQKSLVSIDSRTYDWKLCNTTTGSEYI
Solyc04g063230.2.1   (462) -------------ESQGSSSTDDKKGDKWKLCKTDAGPDYI
AT1G29470.1          (444) -------------KAQVSSI-------KWKVCNVTAGPDYI
AT2G34300.1          (446) -------------KAQQSSISKDQSSYGWKTCNVTAGPDYI
Bradi4g23610.1       (438) GANNNKNNGTSSLSSSSSTTTVSWPYAWKLCNTSAGADYI
LOC_Os11g08314.1     (440) KKKKVKAASVAAAAEEEGGGGGAASLGWRLCNTSAGADYI
Si028042m            (442) ------KAKGNKKKKAPGGGAATPAGKWKLCNSSAGADYI
LOC_Os01g66110.1     (424) ----------ESQAASNSSD--DETTYNWKLCNNNAGTDYI
Bradi2g57087.1       (422) ----------EAQASSKSSG--DGITYSWKLCNSSAVTDYI
GRMZM2G049269_T01    (426) ----------EVQALPKSSG--DATSYTWKLCNSSASTDYI
Si000354m            (428) ----------EVRASSKSSG--DESSYSWKLCNSSASTDYI
Bradi5g27590.1       (430) -----------KEKTTASS--IPASFSWKLCNVEAGADYI
LOC_Os04g59590.1     (432) ------PHNKQQQQQTASP--TPSSYAWKLCNTEAGPDYI
GRMZM2G002642_T02    (434) -----------KEQTLTSS--SPLSFRWALCNVDAGADYI
Si021320m            (436) -----------KEQTATSS--TPMSFSWKLCNVDARADYI
AT5G64030.1          (464) -----------EAQKGSG---DKLDYKWALCNTTAGPDYI
Solyc05g056580.2.1   (476) -----------EMQKSSESDKESSYIWKLCNSTAGPDYI
Glyma05g32670.1      (472) -----------ESQVSSK----QSTIWKLCNVTAGPDYI
Glyma08g00320.1      (474) -----------ESQVSSK----QSANWKLCNVTAGPDYI
Glyma04g38870.1      (468) -----------ESQESSK--QATGYKWKLCNVTAGPDFI
Glyma06g16050.1      (470) -----------DSQESSK--QPTGYKWKLCNVTAGPDFI
```

Fig. 36J

| | | |
|---|---|---|
| Glyma04g42270.1 | (456) | PCLDNWQAIRKLQSIRHYEHRERHCPDEATTCLVSLPEGY |
| Glyma06g12540.1 | (458) | PCLDNWKAIRKLQSISHYEHRERHCPDEATTCLVSLPEGY |
| Solyc04g063230.2.1 | (462) | PCLDNVQAIRKLQHTSHYEHRERHCPVEASTCLVPLPSGY |
| AT1G29470.1 | (444) | PCLDNWQAIRKLHSTKHYEHRERHCPEESPRCLVSLPEGY |
| AT2G34300.1 | (446) | PCLDNWQAIKKLHTTMHYEHRERHCPEESPHCLVSLPDGY |
| Bradi4g23610.1 | (438) | PCLDNEAAISKLKTNKRYEHRERHCPSTPPTCLVPSPAAY |
| LOC_Os11g08314.1 | (440) | PCLDNEAAIKKLKTTAHYEHRERHCPASPPTCLVPSPEGY |
| Si028042m | (442) | PCLDNEAAIKKLKTDKHYEHRERHCPAEPPTCLVPAPPAY |
| LOC_Os01g66110.1 | (424) | PCLDNEKAIKKLRTTKHYEHRERHCPVEPPTCVVPLPEGY |
| Bradi2g57087.1 | (422) | PCLDNEKAIKKLHSTKHYEHRERHCPDEPPTCLVPLPEGY |
| GRMZM2G049269_T01 | (426) | PCLDNEKAIKKLRTTKHYEHRERHCPEEPPTCLVPLPEGY |
| Si000354m | (428) | PCLDNEKAIKKLRSTKHYEHRERHCPEEPPTCLVPLPEGY |
| Bradi5g27590.1 | (430) | PCLDNVEAIKKLRSDTHYEHRERHCPQEPPTCLVPLPKGY |
| LOC_Os04g59590.1 | (432) | PCLDNLQAIRNLRTTKHYEHRERHCPQHPPTCLVPLPKGY |
| GRMZM2G002642_T02 | (434) | PCLDNVAAIKKLRSTKHYEHRERHCPEKSPTCLVPLPEGY |
| Si021320m | (436) | PCLDNVQAINKLRSTKHYEHRERHCPEKPPTCLVPLPEGY |
| AT5G64030.1 | (464) | PCLDNVQAIRSLPSTKHYEHRERHCPDSPPTCLVPLPDGY |
| Solyc05g056580.2.1 | (476) | PCLDNLEAIRNLRSTKHYEHRERHCPDNPPTCLVPLPEGY |
| Glyma05g32670.1 | (472) | PCLDNLKAIRSLPSTKHYEHRERQCPEEPPTCLVPLPEGY |
| Glyma08g00320.1 | (474) | PCLDNLKAIKSLPSTKHYEHRERQCPKESPTCLVPLPEGY |
| Glyma04g38870.1 | (468) | PCLDNWKAIRSLRSTKHYEHRERHCPEEPPTCLVPVPEGY |
| Glyma06g16050.1 | (470) | PCLDNWKAIRSLQSTKHYEHRERHCPEEPPTCLVPVPEGY |

Fig. 36K

| | | |
|---|---|---|
| Glyma04g42270.1 | (456) | RSPIRWPKSREMIWYNNAPHTKLVVDKGHQNWVKVTGKYL |
| Glyma06g12540.1 | (458) | RSPIRWPKSREMIWYKNAPHTKLVVDKGHQNWVKVTGEYL |
| Solyc04g063230.2.1 | (462) | KKSIGWPRSRDQIWYSNVPHGKLAEVKGHQNWVKVTGEYL |
| AT1G29470.1 | (444) | KRSIKWPKSREKIWYTNIPHTKLAEVKGHQNWVKMSGEYL |
| AT2G34300.1 | (446) | KRSIKWPKSREKIWYNNVPHTKLAEIKGHQNWVKMSGEHL |
| Bradi4g23610.1 | (438) | REPIRWPASRSKIWYHNVPHASLASYKHNQNWVKLSGEHL |
| LOC_Os11g08314.1 | (440) | RDPIRWPRSRDKIWYHNVPHSELAAYKGHQNWVKVSGEYL |
| Si028042m | (442) | RDPIRWPHSRDKIWYHNVPHTALAEYKGHQNWVKVSGEHL |
| LOC_Os01g66110.1 | (424) | KRPVEWPTSRDKVWYSNVPHTKLAEYKGHQNWVKVSGDHL |
| Bradi2g57087.1 | (422) | KRPIEWPKSRDKVWYSNVPHTKLAEYKGHQNWVKVSGDHL |
| GRMZM2G049269_T01 | (426) | KRPIEWPKSRDKVWYSNVPHTRLAEYKGHQNWVKVSGDYL |
| Si000354m | (428) | KRPIEWPKSRDKVWYSNVPHTRLAEYKGHQNWVKVSGDYL |
| Bradi5g27590.1 | (430) | RSPIRWPESRDQIWYNNVPHTKLVEYKGHQNWVNVSGDHL |
| LOC_Os04g59590.1 | (432) | TNPIRWPNSRDQIWYNNVPHTKLVEYKGHQNWVKVSGEYL |
| GRMZM2G002642_T02 | (434) | RNPIRWPKSRDQIWYNNVPHTKLVEYKGHQNWVKVSGEYL |
| Si021320m | (436) | SNPIRWPKSRDQIWYNNVPHTKLIEYKGHQNWVKVSGEHL |
| AT5G64030.1 | (464) | KRPIEWPKSREKIWYTNVPHTKLAEYKGHQNWVKVTGEYL |
| Solyc05g056580.2.1 | (476) | QHSVEWPTSREKIWYHNVPHTKLAEIKGHQNWVKVSGEYL |
| Glyma05g32670.1 | (472) | KRPIEWPKSREKIWYSNVPHTKLAEYKGHQNWVKVTGEYL |
| Glyma08g00320.1 | (474) | KRPIEWPKSREKIWYSNVPHTKLAEYKGHQNWVKVTGEYL |
| Glyma04g38870.1 | (468) | KRPIEWPKSREKIWYYNVPHTKLAKVKGHQNWVKVTGEYL |
| Glyma06g16050.1 | (470) | KRPIEWPKSREKIWYYNVPHTKLAEVKGHQNWVKVTGEYL |

Fig. 36L

```
Glyma04g42270.1     (456) TFPGGGTQFKH-GALHYIEFIQ-KSLPK--IAWGKRSRVI
Glyma06g12540.1     (458) TFPGGGTQFKH-GALNYIEFIQ-KSLPK--IAWGKRSRVI
Solyc04g063230.2.1  (462) TFPGGGTQFKQ-GALHYIDFLQ-KTLPQ--ISWGKQTRVI
AT1G29470.1         (444) TFPGGGTQFKN-GALHYIDFLQ-ESYPD--IAWGNRTRVI
AT2G34300.1         (446) TFPGGGTQFKN-GALHYIDFIQ-QSHPA--IAWGNRTRVI
Bradi4g23610.1      (438) VFPGGGTQFKTGGALHYIDLIQ-EALPE--VAWGRRSRVV
LOC_Os11g08314.1    (440) TFPGGGTQFKH-GALHYIELIQ-SSFPE--VAWGRRSRVA
Si028042m           (442) TFPGGGTQFKH-GALRYIDLIQAAAAPEGAVAWGRRSRVV
LOC_Os01g66110.1    (424) LFPGGGTQFKN-GALHYIDTIQ-QALPD--IAWGKRSRVI
Bradi2g57087.1      (422) LFPGGGTQFKN-GALHYIDTIQ-QALPD--IAWGKRSRVI
GRMZM2G049269_T01   (426) LFPGGGTQFKN-GALHYIDTIQ-QALPD--IAWGKRSRVI
Si000354m           (428) LFPGGGTQFKN-GALHYIDTIQ-QALPN--IAWGKRSRVI
Bradi5g27590.1      (430) IFPGGGTQFKR-GALHYIDFIQ-EAKKD--VAWGKRTRVV
LOC_Os04g59590.1    (432) TFPGGGTQFKH-GALHYIDFIQ-EAKKD--IAWGKQTRVV
GRMZM2G002642_T02   (434) TFPGGGTQFKH-GALRYIDFIQ-EAKKD--VAWGKRSRVV
Si021320m           (436) IFPGGGTQFKH-GALHYIDFIQ-EAKKD--IAWGKRTRVV
AT5G64030.1         (464) TFPGGGTQFKH-GALHYIDFIQ-ESVPA--IAWGKRSRVV
Solyc05g056580.2.1  (476) TFPGGGTQFKH-GALHYIDFIQ-QSFPE--IAWGKQTRVI
Glyma05g32670.1     (472) TFPGGGTQFKH-GALHYIDTIQ-QSVPD--IAWGNRSRVI
Glyma08g00320.1     (474) TFPGGGTQFKH-GALHYIDTIQ-QSVPD--IAWGNRSRVI
Glyma04g38870.1     (468) TFPGGGTQFKH-GALHYIDFIQ-ETEPD--IAWGKRTRVI
Glyma06g16050.1     (470) TFPGGGTQFKH-GALHYIDFIQ-ETVPD--IAWGKRTRVI
consensus           (861)                                       VX
```

Fig. 36M

| | | |
|---|---|---|
| Glyma04g42270.1 | (456) | LDVGCGVASFGGYLFEKDVLTMSFAPKDVHEAQVQFALER |
| Glyma06g12540.1 | (458) | LDVGCGVASFGGYLFEKDVLTMSFAPKDVHEAQVQFALER |
| Solyc04g063230.2.1 | (462) | LDVGCGVASFGGYLFERDVLAMSLAPKDEHEAQVQFALER |
| AT1G29470.1 | (444) | LDVGCGVASFGGYLFDRDVLALSFAPKDEHEAQVQFALER |
| AT2G34300.1 | (446) | LDVGCGVASFGGYLFERDVLALSFAPKDEHEAQVQFALER |
| Bradi4g23610.1 | (438) | LDVGCGVASFGGFLFDRGALTMSFAPKDEHEAQVQFALER |
| LOC_Os11g08314.1 | (440) | LDVGCGVASFGGYLFDHDVLTMSLAPKDEHEAQVQFALER |
| Si028042m | (442) | LDVGCGVASFGGYLFDRDVLTMSLAPKDEHEAQVQFALER |
| LOC_Os01g66110.1 | (424) | LDVGCGVASFGGYMFERDVLTMSFAPKDEHEAQVQFALER |
| Bradi2g57087.1 | (422) | LDVGCGVASFGGYMFDRDVLTMSFAPKDEHEAQVQFALER |
| GRMZM2G049269_T01 | (426) | LDVGCGVASFGGYMFDRDALTMSFAPKDEHEAQVQFALER |
| Si000354m | (428) | LDVGCGVASFGGYMFDRDVLTMSFAPKDEHEAQVQFALER |
| Bradi5g27590.1 | (430) | LDVGCGVASFGGYLFDRDVLTMSFAPKDEHEAQVQFALER |
| LOC_Os04g59590.1 | (432) | LDVGCGVASFGGYLFDRDVLTMSFAPKDEHEAQVQFALER |
| GRMZM2G002642_T02 | (434) | LDVGCGVASFGGYLFDRDVITMSFAPKDEHEAQVQFALER |
| Si021320m | (436) | LDVGCGVASFGGYLFDRDVITMSFAPKDEHEAQVQFALER |
| AT5G64030.1 | (464) | LDVGCGVASFGGFLFDRDVITMSLAPKDEHEAQVQFALER |
| Solyc05g056580.2.1 | (476) | LDVGCGVASFGGYLFERDVLAMSLAPKDEHEAQVQFALER |
| Glyma05g32670.1 | (472) | LDVGCGVASFGGFLFERDVLTMSLAPKDEHEAQVQFALER |
| Glyma08g00320.1 | (474) | LDVGCGVASFGGFLFERDVLTMSLAPKDEHEAQVQFALER |
| Glyma04g38870.1 | (468) | LDVGCGVASFGGFLFDRDVLAMSLAPKDEHEAQVQFALER |
| Glyma06g16050.1 | (470) | LDVGCGVASFGGFLFDRDVLAMSLAPKDEHEAQVQFALER |
| consensus | (861) | LDVCCGVASFGGXXFXXXXXXXSXAPKDXHEAQVQFALER |

Fig. 36N

| | | |
|---|---|---|
| Glyma04g42270.1 | (456) | GIPATLGVMGTVRLPYPGSVFDLVHCARCRVPWHIEGGKL |
| Glyma06g12540.1 | (458) | GIPATLGVMGTVRLPYPGSVFDLLHCARCRVPWHVEGGKL |
| Solyc04g063230.2.1 | (462) | GIPAISAVMGTKRLPFPGKVFDAVHCARCRVPWHIEGGKL |
| AT1G29470.1 | (444) | GIPAMSNVMGTKRLPFPGSVFDLIHCARCRVPWHIEGGKL |
| AT2G34300.1 | (446) | GIPAMLNVMGTKRLPFPGSVFDLIHCARCRVPWHIEGGKL |
| Bradi4g23610.1 | (438) | GIPALSAVMGTKRLPFPAGVFDVVHCARCRVPWHIDGGML |
| LOC_Os11g08314.1 | (440) | GIPAISAVMGTRRLPFPSNVFDAVHCARCRVPWHIEGGML |
| Si028042m | (442) | GIPAISAVMGTRRLPFPGGVFDVVHCARCRVPWHIDGGML |
| LOC_Os01g66110.1 | (424) | GIPAISAVMGTKRLPYPSRVFDVIHCARCRVPWHIEGGML |
| Bradi2g57087.1 | (422) | GIPAISAVMGTKRLPYPSRVFDVIHCARCRVPWHIEGGKL |
| GRMZM2G049269_T01 | (426) | GIPAISAVMGTKRLPYPSRVFDVIHCARCRVPWHIEGGML |
| Si000354m | (428) | GIPAISAVMGTKRLPYPSRVFDVIHCARCRVPWHIEGGML |
| Bradi5g27590.1 | (430) | GIPAISAVMGTKRLPFPGRVFDAVHCARCRVPWHIEGGKL |
| LOC_Os04g59590.1 | (432) | GIPAMSAVMGTKRLPFPGRVFDVVHCARCRVPWHIEGGKL |
| GRMZM2G002642_T02 | (434) | GIPAISAVMGTKRLPFPSRVFDVVHCARCRVPWHIEGGKL |
| Si021320m | (436) | GIPAISAVMGTKRLPFPSRVFDVVHCARCRVPWHIEGGKL |
| AT5G64030.1 | (464) | GIPAISAVMGTTRLPFPGRVFDIVHCARCRVPWHIEGGKL |
| Solyc05g056580.2.1 | (476) | GIPAISAVMGTKRLPFPSRVFDVVHCARCRVPWHIEGGKL |
| Glyma05g32670.1 | (472) | GIPAISAVMGTKRLPYPGRVFDVVHCARCRVPWHIEGGKL |
| Glyma08g00320.1 | (474) | GIPAISAVMGTKRLPYPGRVFDVVHCARCRVPWHIEGGKL |
| Glyma04g38870.1 | (468) | GIPAISAVMGTKRLPFPGKVFDVVHCARCRVPWHIEGGKL |
| Glyma06g16050.1 | (470) | GIPAISAVMGTKRLPFPGKVFDVVHCARCRVPWHIEGGKL |
| consensus | (861) | GIPAXXXVMGTXRLPXPXXVFDXXHCARCRVPWHXXGGXL |

Fig. 36O

| | | |
|---|---|---|
| Glyma04g42270.1 | (456) | LLELNRVLRPGGHFVWSATPVYQKDPEDVEIWKAMGEITK |
| Glyma06g12540.1 | (458) | LLELNRVLRPGGYFVWSATPVYQKDPEDVEIWKAMGEITK |
| Solyc04g063230.2.1 | (462) | LLELNRVLRPGGHFIWSATPVYRKDEENVGIWEAMSELTK |
| AT1G29470.1 | (444) | LLELNRALRPGGFFVWSATPVYRKTEDVGIWKAMSKLTK |
| AT2G34300.1 | (446) | LLELNRALRPGGFFVWSATPVYRKNEDSGIWKAMSELTK |
| Bradi4g23610.1 | (438) | LLELNRLLRPGGFFVWSATPVYQKLPEDVEIWDDMVKLTK |
| LOC_Os11g08314.1 | (440) | LLELNRLLRPGGFFVWSATPVYQELPEDVEIWGEMVKLTK |
| Si028042m | (442) | LLELNRLLRPGGVFVWSATPVYQKLPDDVEIWDEMAKLTK |
| LOC_Os01g66110.1 | (424) | LLELNRLLRPGGYFVWSATPVYQKLPEDVEIWNAMSSLTK |
| Bradi2g57087.1 | (422) | LLELNRLLRPGGYFVWSATPVYQKLPEDVEIWNAMSSLTK |
| GRMZM2G049269_T01 | (426) | LLELNRLLRPGGYFVWSATPVYQKLPEDVEIWNAMSTLTK |
| Si000354m | (428) | LLELNRLLRPGGYFVWSATPVYQKLPEDVEIWNAMSALTK |
| Bradi5g27590.1 | (430) | LLELDRLLRPGGYFVWSATPAYQKLPEDVEIWQAMSALTR |
| LOC_Os04g59590.1 | (432) | LLELDRLLRPGGYFVWSATPVYQKLPEDVEIWEAMSTLTR |
| GRMZM2G002642_T02 | (434) | LLELDRLLRPGGYFVWSATPVYQKLPEDVEIWQAMSALTS |
| Si021320m | (436) | LLELDRLLRPGGYFVWSATPVYQKLPEDVEIWEAMSALTR |
| AT5G64030.1 | (464) | LLELNRVLRPGGFFVWSATPVYQKKTEDVEIWKAMSELIK |
| Solyc05g056580.2.1 | (476) | LLELNRVLRPGGLFVWSATPVYQKLPEDVEIWEAMQKLTK |
| Glyma05g32670.1 | (472) | LLELNRVLRPGGFFVWSATPIYQKLPEDVEIWNEMKALTK |
| Glyma08g00320.1 | (474) | LLELNRVLRPGGFFVWSATPIYQKLPEDVEIWNEMKALTK |
| Glyma04g38870.1 | (468) | LLELNRVLRPGGFFVWSATPIYQKLPEDVEIWKAMKTLTK |
| Glyma06g16050.1 | (470) | LLELNRVLRPGGFFVWSATPIYQKLPEDVEIWKAMKALTK |
| consensus | (861) | LLELXRXLRPGGXFXWSATPXYXXXXXXXXIWXXMXXXXX |

Fig. 36P

| | | |
|---|---|---|
| Glyma04g42270.1 | (456) | SMCWDLVVIAKDKL--NGVAAAIYRKPTDNCYNNRIKHE |
| Glyma06g12540.1 | (458) | SMCWDLVVIAKDKL--NGVAAAIYRKPTDNCYNNRIKNE |
| Solyc04g063230.2.1 | (462) | SMCWELLEINEDKL--NEVGVAIFRKPTTNDCYQSRTQND |
| AT1G29470.1 | (444) | AMCWELMTIKKDEL--NEVGAAIYQKPMSNKCYNERSQNE |
| AT2G34300.1 | (446) | AMCWKLVTIKKDKL--NEVGAAIYQKPTSNKCYNKRPQNE |
| Bradi4g23610.1 | (438) | AMCWEMVKKTEDTL--DQVGLVIFRKPKSNRCYETRRQKE |
| LOC_Os11g08314.1 | (440) | AMCWEMVSKTSDTV--DQVGLVTFRKPADNACYMKRRQKE |
| Si028042m | (442) | AMCWEMVAKTKHTVVDDQVGVAIFRKPERNGCYEKRPEKA |
| LOC_Os01g66110.1 | (424) | AMCWKMVNKTKDKL--NQVGMAIYQKPMDNSCYEKRPENS |
| Bradi2g57087.1 | (422) | SMCWKMVKKTKDTL--NQVGMAIYQKPMDNNCYEKRSEDS |
| GRMZM2G049269_T01 | (426) | SMCWKMVNKTKDKL--NQVGMVIYQKPMDNICYEKRSENS |
| Si000354m | (428) | SMCWKMVNKTKDKL--NQVGMAIYQKPMDNNCYEKRSENN |
| Bradi5g27590.1 | (430) | SMCWKMVNKVKDRL--NRVGVAIFQKPIDNRCYDGRSAAN |
| LOC_Os04g59590.1 | (432) | SMCWEMVNKVKDRV--NRVGIAIFRKPTDNSCYEARSAAN |
| GRMZM2G002642_T02 | (434) | SMCWKMVNKVKDRV--NRVGIAIYRKPTDNSCYEARSETN |
| Si021320m | (436) | SMCWKMVNKVKDRV--NRVGIAIFRKPTDNSCYEERSEAN |
| AT5G64030.1 | (464) | KMCWELVSINKDTI--NGVGVATYRKPTSNECYKNRSEPV |
| Solyc05g056580.2.1 | (476) | AMCWDLVSKTKDRV--NGVGVAVYRKPTSNECYEQRSKDA |
| Glyma05g32670.1 | (472) | AMCWEVVSISKDKL--NGVGIAVYKKPTSNECYEKRSQNQ |
| Glyma08g00320.1 | (474) | AMCWEVVSISKDKL--NGVGIAVYKKPTSNECYEKRSQNQ |
| Glyma04g38870.1 | (468) | AMCWEVVSISKDQV--NGVGVAVYKKPTSNECYEQRSKNE |
| Glyma06g16050.1 | (470) | AMCWEVVSISKDPV--NGVGVAVYRKPTSNECYEQRSKNE |
| consensus | (861) | XMCWXXXXXXXXXXXXVXXXXXXKPXXNXCYXXRXXXX |

Fig. 36Q

| | | |
|---|---|---|
| Glyma04g42270.1 | (456) | PPMCSESDDPNTAWNVSLQACMHKVPVD-ASERGSIWPEQ |
| Glyma06g12540.1 | (458) | PSMCSESDDPNTAWNVSLQACMHKVPVD-ASERGSIWPEQ |
| Solyc04g063230.2.1 | (462) | PPMCEEADDPDAAWNITLQACLHKAPAD-ASARGAKWPAK |
| AT1G29470.1 | (444) | PPLCKDSDDQNAAWNVPLEACIHKVTED-SSKRGAVWPES |
| AT2G34300.1 | (446) | PPLCKDSDDQNAAWNVPLEACMHKVTED-SSKRGAVWPNM |
| Bradi4g23610.1 | (438) | PPLCDGSDDPNAAWNIKLRACMHRAPADYPSVRGSRWPAP |
| LOC_Os11g08314.1 | (440) | PPLCEPSDDPNAAWNITLRACMHWVPTD-PSVRGSWWPER |
| Si028042m | (442) | PPLCEPSDDPNAAWNIKLRACMHRVPED-PSERGARWPEP |
| LOC_Os01g66110.1 | (424) | PPLCKETDDADAAWNVPLQACMHKLPAG-QSVRGSKWPET |
| Bradi2g57087.1 | (422) | PPLCKETDDADASWNITLQACIHKLPVG-PSVRGSKWPEF |
| GRMZM2G049269_T01 | (426) | PPLCKESDDADAAWNVPLEACMHKLPGG-SKVRGSKWPEL |
| Si000354m | (428) | PPLCKDSDDADAAWNVPLEACMHKLPAG-PTVRGAKWPES |
| Bradi5g27590.1 | (430) | LPLCGEYDNVDAAWNVSLESCIHKLPVD-PAIRSSRWPEE |
| LOC_Os04g59590.1 | (432) | PPICGEYDDPDAAWNISLQSCVHRLPTD-PAIRGSQWPVE |
| GRMZM2G002642_T02 | (434) | PPLCGEYDDPDAAWNISLGACMHKLPVD-PTVRGSQWPEL |
| Si021320m | (436) | SPICGEYDDPDAAWNVSLRTCMHKLPVD-LTIRGSKWPEL |
| AT5G64030.1 | (464) | PPICADSDDPNASWKVPLQACMHTAPED-KTQRGSQWPEQ |
| Solyc05g056580.2.1 | (476) | PPICQGSDDPNAAWNVPLQACMHKAPVA-TSERGSQWPEP |
| Glyma05g32670.1 | (472) | PPICPDSDDPNAAWNIPLQACMHKVPVS-STERGSQWPEK |
| Glyma08g00320.1 | (474) | PPICPDSDDPNAAWNVPLQACMHKVPVS-STERGSQWPEK |
| Glyma04g38870.1 | (468) | PPLCPDSDDPNAAWNIKLQACMHKVPAS-SKERGSKLPEL |
| Glyma06g16050.1 | (470) | PPLCPDSDDPNAAWNIQLQACLHKAPVG-SKERGSKLPEL |
| consensus | (861) | XXXCXXXDXXXXXWXXXLXXCXHXXXXXXXXXRXXXXPXX |

Fig. 36R

```
Glyma04g42270.1     (456) WPLRLEKPPYWID-SQAGVYGRAASVEFTADYKHWKNVIS
Glyma06g12540.1     (458) WPLRLEKPPYWID-SQAGVYGRAASVEFTADYKHWKNVIS
Solyc04g063230.2.1  (462) WPLRSEKLPYWLKSSQVGVYGKAAPEDFAADYDHWKNVVS
AT1G29470.1         (444) WPERVETVPQWLD-SQEGVYGKPAQEDFTADHERWKTIVS
AT2G34300.1         (446) WPERVETAPEWLD-SQEGVYGKPAPEDFTADQEKWKTIVS
Bradi4g23610.1      (438) WPERAEAVPYWLNNSQVGVYGRPAREDFAADYEHWRKVVQ
LOC_Os11g08314.1    (440) WPERMEKTPYWLNSSQVGVYGKPAPEDFVADQEHWRKVVR
Si028042m           (442) WPERLGKAPYWLDGSQTGVYGKPAPEDFAADLEHWRKVVR
LOC_Os01g66110.1    (424) WPQRLEKTPYWIDDSHVGIYGKPGNEDFEADYAHWKRVVS
Bradi2g57087.1      (422) WPQRLEKTPFWIDGSHVGVYGKPANEDFEADYAHWKRVVS
GRMZM2G049269_T01   (426) WPQRLEKTPFWIDGSKVGVYGKPANEDFEADNAHWKRVVS
Si000354m           (428) WPQRLEKTPFWLNGSQVGVYGKPANEDFEADNAHWKRVVS
Bradi5g27590.1      (430) WPLRLERAPYWLKSSEPGVYGKPAPEDFEADYDHWKRVIS
LOC_Os04g59590.1    (432) WPLRLEKPPYWLKNSEAGVYGKPATEDFQADYEHWKQVIS
GRMZM2G002642_T02   (434) WPLRLEKPPYWLRGSEAGVYGKPAPEDFQADYEHWKRVVS
Si021320m           (436) WPLRLEKPPYWLKSSEAGVYGKPAPEDFQVDYEHWKRVVS
AT5G64030.1         (464) WPARLEKAPFWLSSSQTGVYGKAAPEDFSADYEHWKRVVT
Solyc05g056580.2.1  (476) WPARLSKSPYWLLSSQVGVYGKPAPEDFTADYEHWKHVVT
Glyma05g32670.1     (472) WPARLTNTPYWLTNSQVGVYGKPAPEDFTADYEHWKRIVS
Glyma08g00320.1     (474) WPARLTNIPYWLTNSQVGVYGKPAPEDFTADYGHWKRIVS
Glyma04g38870.1     (468) WPARLTKVPYWLLSSQVGVYGKPAPEDFTADYEHWKRVVS
Glyma06g16050.1     (470) WPARLIKVPYWLSSSQVGVYGKPAPQDFTADYEHWKRVVS
consensus           (861) WPXRXXXXPXWXXXSXXGXY
```

Fig. 36S

| | | |
|---|---|---|
| Glyma04g42270.1 | (456) | HSYLNGMGINWSSVRNVMDMKAVYGGFAAALRALKVNVWV |
| Glyma06g12540.1 | (458) | HLYLNGMGINWSSVRNVMDMKAVYGGFAAALRALKLNVWV |
| Solyc04g063230.2.1 | (462) | KSYLNDLGINWSSVRNVMDMKAIYGGFAAALKDLK--VWV |
| AT1G29470.1 | (444) | KSYLNGMGIDWSYVRNVMDMRAVYGGFAAALKDLK--LWV |
| AT2G34300.1 | (446) | KAYLNDMGIDWSNVRNVMDMRAVYGGFAAALKDLK--LWV |
| Bradi4g23610.1 | (438) | NSYLTGMGIDWAAVRNVMDMRAVYGGLAAALRDMS--VWV |
| LOC_Os11g08314.1 | (440) | NSYLTGMGIDWKTVRNVMDMRAVYGGFAAALRDMS--VWV |
| Si028042m | (442) | SSYLAGMGIDWKTIRNVMDMRAVYGGLAAALREME--VWV |
| LOC_Os01g66110.1 | (424) | KSYVNGMGIDWSKVRNVMDMRAVYGGFAAALRDQK--VWV |
| Bradi2g57087.1 | (422) | KSYVNGMGIDWSKVRNVMDMRAVYGGFAAALRGQR-QVWV |
| GRMZM2G049269_T01 | (426) | KSYVNGMGIDWSKVRNVMDMRAVYGGFAAALRDQK--VWV |
| Si000354m | (428) | KSYVNGMGIDWSKVRNVMDMRAVYGGFAAALRDQK--VWV |
| Bradi5g27590.1 | (430) | NSYMDGLGIDWSAVRNVMDMNAVYGGFAAALRDVK--VWV |
| LOC_Os04g59590.1 | (432) | NSYMNDLGIDWSAVRNVMDMKAAYGGFAAALRDLK--LWV |
| GRMZM2G002642_T02 | (434) | NSYMNGLGIDWSTVRNVMDMKAVYAGFAAALRDLK--VWV |
| Si021320m | (436) | NSYMNGLGVDWSAVRNVMDMKAVYGGFAAALHDLK--VWV |
| AT5G64030.1 | (464) | KSYLNGLGINWASVRNVMDMRAVYGGFAAALRDLK--VWV |
| Solyc05g056580.2.1 | (476) | NSYLNGMGINWSTVRNVMDMRAIYGGFAAALRDLN--VWV |
| Glyma05g32670.1 | (472) | KSYLNGIGINWSNVRNVMDMRSVYGGFAAALKDLN--IWV |
| Glyma08g00320.1 | (474) | KSYLNGIGINWSNMRNVMDMRSVYGGFAAALKDLN--IWV |
| Glyma04g38870.1 | (468) | QSYLDGMGIKWSNVRNVMDMRSIYGGFAAALRDLN--VWV |
| Glyma06g16050.1 | (470) | KSYLDGMGIKWSNVRNVMDMRSIYGGFAAALRDLN--VWV |

Fig. 36T

| | | |
|---|---|---|
| Glyma04g42270.1 | (456) | MNVVPIDSPDTLPIIYERGLFGIYHDWCESLNTYPRSYDL |
| Glyma06g12540.1 | (458) | MNVVPIDSPDTLPIIYERGLFGIYHDWCESFNTYPRSYDL |
| Solyc04g063230.2.1 | (462) | MNVVPIDSPDTLPIIYDRGLFGIYHDWCESFSTYPRSYDL |
| AT1G29470.1 | (444) | MNVVPIDSPDTLPIIYERGLFGIYHDWCESFSTYPRTYDL |
| AT2G34300.1 | (446) | MNVVPVDAPDTLPIIYERGLFGIYHDWCESFNTYPRTYDL |
| Bradi4g23610.1 | (438) | MNTVTIDSPDTLPVIFERGLFGIYHDWCESFSTYPRSYDL |
| LOC_Os11g08314.1 | (440) | MNVVTINSPDTLPVIYERGLFGIYHDWCESFSTYPRSYDL |
| Si028042m | (442) | MNVVTIDSPDTLPVIYERGLFGIYHDWCESFSTYPRSYDL |
| LOC_Os01g66110.1 | (424) | MNIVPTDSADTLPIIYERGLFGMYHDWCESFSTYPRTYDL |
| Bradi2g57087.1 | (422) | MNIVPIDSPDTLPIIYERGLFGMYHDWCESFSTYPRTYDL |
| GRMZM2G049269_T01 | (426) | MNTVPIDSPDTLPIIYERGLFGMYHDWCESFSTYPRTYDL |
| Si000354m | (428) | MNIVPIDSPDTLPIIYERGLFGMYHDWCESFSTYPRTYDL |
| Bradi5g27590.1 | (430) | MNVVPIDSPDTLAIIYERGLFGLYHDWCESFSTYPRSYDL |
| LOC_Os04g59590.1 | (432) | MNVIPIDSPDTLPIIYERGLFGIYHDWCESFSTYPRTYDL |
| GRMZM2G002642_T02 | (434) | MNVVPIDSPDTLPIIYERGLFGLYHDWCESFSTYPRTYDL |
| Si021320m | (436) | MNVIPIDSPDTLPIIYERGLFGLYHDWCESFSTYPRTYDL |
| AT5G64030.1 | (464) | MNVVPIDSPDTLAIIYERGLFGIYHDWCESFSTYPRSYDL |
| Solyc05g056580.2.1 | (476) | MNVVSVDAPDTLPIIYERGLFGIYHDWCESFSTYPRSYDL |
| Glyma05g32670.1 | (472) | MNVVSVNSADTLPIIYERGLFGMYHDWCESFSTYPRSYDL |
| Glyma08g00320.1 | (474) | MNVVSVNSADTLPLIYERGLFGMYHDWCESFSTYPRSYDL |
| Glyma04g38870.1 | (468) | MNVVTIDSPDTLPIIFERGLFGIYHDWCESFSTYPRTYDL |
| Glyma06g16050.1 | (470) | MNVVTIDSPDTLPIIYERGLFGIYHDWCESFSTYPRTYDL |

Fig. 36U

```
Glyma04g42270.1      (456) LHADSIFSTLKE--KCNILAVIAEVDRILRPEGYLVIRDN
Glyma06g12540.1      (458) LHADSIFSTLKE--KCNKVAVIAEVDRILRPEGYLVIRDN
Solyc04g063230.2.1   (462) LHADHLFSDIKK--RCTIESVFAEVDRILRPEGKLIVRDN
AT1G29470.1          (444) LHADHLFSSLKK--RCNLVGVMAEVDRILRPQGTFIVRDD
AT2G34300.1          (446) LHADHLFSTLRK--RCNLVSVMAEIDRILRPQGTFIIRDD
Bradi4g23610.1       (438) LHADHLFSKLKT--RCKVLPVIVEADRILRPNGKLIVRDD
LOC_Os11g08314.1     (440) LHADHLFSKLKS--RCEVLPVIVEVDRILRPNGKLIVRDD
Si028042m            (442) LHADHLFSKLKP--RCKVLPVVVEVDRILRPNGKFIVRDD
LOC_Os01g66110.1     (424) LHADHLFSKLKK--RCKLLPVFAEVDRILRPEGKLIVRDN
Bradi2g57087.1       (422) LHADHLFSKLKK--RCKLLGVFAEVDRILRPEGKLIVRDS
GRMZM2G049269_T01    (426) LHADHLFSKLRK--RCKLAAVFAEVDRVLRPQGKLIVRDT
Si000354m            (428) LHADHLFSKLKK--RCKLMAVFAEVDRVLRPQGKLIVRDT
Bradi5g27590.1       (430) VHADHIFSKVKK--RCGLLSVIVEVDRMARPEGRLIVRDD
LOC_Os04g59590.1     (432) LHANHLFSKIKKSDRCKLVAVMVEVDRILRPGGRLIVRDS
GRMZM2G002642_T02    (434) VHANHLFSKVKK--RCELLPVIVEVDRVLRPQGRLIVRDN
Si021320m            (436) LHANHLFSKVKK--RCELLPVVVEVDRVLRPEGRLIVRDN
AT5G64030.1          (464) LHADHLFSKLKQ--RCNLTAVIAEVDRVLRPEGKLIVRDD
Solyc05g056580.2.1   (476) VHADHLFSKIKT--KCGLPAIVAEVDRILRPGGKLIVRDK
Glyma05g32670.1      (472) LHADNLFSNIKN--RCNLKAVVAEIDRILRPEGKLIVRDT
Glyma08g00320.1      (474) LHADNLFSNIKN--RCSLKAVVAEIDRILRPEGKLIVRDT
Glyma04g38870.1      (468) LHADHLFSKLKK--RCNLAAVVAEADRILRPEGKLIVRDT
Glyma06g16050.1      (470) LHADHLFSKLKK--RCNLAAVVAEADRILRPEGKLIVRDT
```

Fig. 36V

| | | |
|---|---|---|
| Glyma04g42270.1 | (456) | VETIGEIESMAKSLHWDIQLTYSKNGEGFLCIQKTFWRPT |
| Glyma06g12540.1 | (458) | VETIGEIESLAKSLQWDIRLTYSKNGEGLLCIQKTFWRPT |
| Solyc04g063230.2.1 | (462) | AETILEIENMARSVKWKVKMSYSKNGEGLLFVQKSFWRPN |
| AT1G29470.1 | (444) | METIGEIEKMVKSMKWNVRMTHSKDGEGLLSVQKSWWRPT |
| AT2G34300.1 | (446) | METLGEVEKMVKSMKWKVKMTQSKDNEGLLSIEKSWWRPE |
| Bradi4g23610.1 | (438) | KETVNEIVELVRSMHWEVRMTVSNRKEAMLCARKTMWRPT |
| LOC_Os11g08314.1 | (440) | KETVDEIKGVVRSLQWEVRMTVSKNREAMLCARKTTWRPT |
| Si028042m | (442) | KETVDEIQSAVRSLQWEVRMTVSKNKEAMLCARKTTWRPT |
| LOC_Os01g66110.1 | (424) | AETINELQGMVKSLQWEVRMTYTKGNEGLLCVQKSMWRPK |
| Bradi2g57087.1 | (422) | AETIIELEGMAKSLHWEVTMTYAKGNEGLLCVQKTMWRPK |
| GRMZM2G049269_T01 | (426) | ADTINELESMAKSVQWEVRMTYTKGSEGLLCVEKSMWRPK |
| Si000354m | (428) | ADTINELESMAKSLKWEVRMTYTKGNEGLLCVEKSMWRPK |
| Bradi5g27590.1 | (430) | METINEVRSIAESLHWEVRLSYSQEKEGLLFVQKTMWRPS |
| LOC_Os04g59590.1 | (432) | METMHEVESMAKSLHWEVRKSYSQDNEGLLFVEKTMWRPN |
| GRMZM2G002642_T02 | (434) | IETTSEVENILKSLHWEVRMSYFQEKEGLLLVQKTTWRPN |
| Si021320m | (436) | IETISEVENIVKSLHWEVRMSYSQDKEGLLFVQKTSWRPN |
| AT5G64030.1 | (464) | AETIQQVEGMVKAMKWEVRMTYSKEKEGLLSVQKSIWRPS |
| Solyc05g056580.2.1 | (476) | EETITELESMLKSMQYEINMTYSKDKEGLLYCQKTMWRPK |
| Glyma05g32670.1 | (472) | VEIISEIESMVKSMKWEVRMTYSKDKVGFLCVQKSMWRPK |
| Glyma08g00320.1 | (474) | VEIINEMESMVKSMQWEVRMTYSKDKVGFLCVQKSMWRPK |
| Glyma04g38870.1 | (468) | VEIVEELESMARSMQWKVRMTYSKDKEGLLCVEKSKWRPK |
| Glyma06g16050.1 | (470) | VEIIEELESMARSMQWKVRMTYSKDKEGLLCVEKSKWRPK |

Fig. 36W

| | | |
|---|---|---|
| Glyma04g42270.1 | (456) | KVETVASAIA |
| Glyma06g12540.1 | (458) | KVETVASAIA |
| Solyc04g063230.2.1 | (462) | QEQIVKSAIA |
| AT1G29470.1 | (444) | EAETIQSAIA |
| AT2G34300.1 | (446) | ETETIKSAIA |
| Bradi4g23610.1 | (438) | EVEARR---- |
| LOC_Os11g08314.1 | (440) | EAEAR----- |
| Si028042m | (442) | EVESR----- |
| LOC_Os01g66110.1 | (424) | EIEASM---- |
| Bradi2g57087.1 | (422) | EIEASM---- |
| GRMZM2G049269_T01 | (426) | ELDAST---- |
| Si000354m | (428) | ELEAST---- |
| Bradi5g27590.1 | (430) | PSS------- |
| LOC_Os04g59590.1 | (432) | EVEAKL---- |
| GRMZM2G002642_T02 | (434) | ETEAKL---- |
| Si021320m | (436) | EVEAKL---- |
| AT5G64030.1 | (464) | EVETLTYAIG |
| Solyc05g056580.2.1 | (476) | DVETLTYAIA |
| Glyma05g32670.1 | (472) | ELETLEYAIG |
| Glyma08g00320.1 | (474) | ELETLEYAIG |
| Glyma04g38870.1 | (468) | EQEKLEYAIV |
| Glyma06g16050.1 | (470) | EQEKLEYAIA |

Fig. 36X

YIELD IMPROVEMENT IN PLANTS

CROSS REFERENCE TO RELATED APPLICATIONS

This application incorporates by reference in its entirety, and is a National Phase of, International Patent Application No. PCT/US2014/060267 filed on 13 Oct. 2014, which claims priority from U.S. Provisional Application No. 61/890,613, filed on 14 Oct. 2013, which is incorporated by reference herein in its entirety.

FIELD OF THE INVENTION

The present invention relates to plant genomics and plant improvement.

BACKGROUND OF THE INVENTION

A plant's phenotypic characteristics that enhance photosynthetic resource use efficiency may be controlled through a number of cellular processes. One important way to manipulate that control is by manipulating the characteristics or expression of regulatory proteins, proteins that influence the expression of a particular gene or sets of genes. For example, transformed or transgenic plants that comprise cells with altered levels of at least one selected regulatory polypeptide may possess advantageous or desirable traits, and strategies for manipulating traits by altering a plant cell's regulatory polypeptide content or expression level can result in plants and crops with commercially valuable properties. Examples of such trait manipulation include:

Increasing Canopy Photosynthesis to Increase Crop Yield.

Recent studies by crop physiologists have provided evidence that crop-canopy photosynthesis is correlated with crop yield, and that increasing canopy photosynthesis can increase crop yield (Long et al., 2006. *Plant Cell Environ.* 29:315-33; Murchie et al., 2009 *New Phytol.* 181:532-552; Zhu et al., 2010. *Ann. Rev. Plant Biol.* 61:235-261). Two overlapping strategies for increasing canopy photosynthesis have been proposed. The first recognizes great potential to increase canopy photosynthesis by improving multiple discrete reactions that currently limit photosynthetic capacity (reviewed in Zhu et al., 2010. supra). The second focuses upon improving plant physiological status during environmental conditions that limit the realization of photosynthetic capacity. It is important to distinguish this second goal from recent industry and academic screening for genes to improve stress tolerance. Arguably, these efforts may have identified genes that improve plant physiological status during severe stresses not typically experienced on productive acres (Jones, 2007. *J. Exp. Bot.* 58:119-130; Passioura, 2007. *J. Exp. Bot.* 58:113-117). In contrast, improving the efficiency with which photosynthesis operates relative to the availability of key resources of water, nitrogen and light, is thought to be more appropriate for improving yield on productive acres (Long et al., 1994. *Ann. Rev. Plant Physiol. Plant Molec. Biol.* 45:633-662; Morison et al., 2008. *Philosophical Transactions of the Royal Society B: Biological Sciences* 363:639-658; Passioura, 2007, supra).

Increasing Nitrogen Use Efficiency (NUE) to Increase Crop Yield.

There has been a large increase in food productivity over the past 50 years causing a decrease in world hunger despite a significant increase in population (Godfray et al., 2010. *Science* 327:812-818). A significant contribution to this increased yield was a 20-fold increase in the application of nitrogen fertilizers (Glass, 2003. *Crit. Rev. Plant Sci.* 22:453-470). About 85 million to 90 million metric tons of nitrogen are applied annually to soil, and this application rate is expected to increase to 240 million metric tons by 2050 (Good et al., 2004. *Trends Plant Sci.* 9:597-605). However, plants use only 30 to 40% of the applied nitrogen and the rest is lost through a combination of leaching, surface run-off, denitrification, volatilization, and microbial consumption (Frink et al., 1999. *Proc. Natl. Acad. Sci. USA* 96:1175-1180; Glass, 2003, supra; Good et al., 2004, supra; Raun and Johnson, 1999. *Agron. J.* 91:357-363). The loss of more than 60% of applied nitrogen can have serious environmental effects, such as groundwater contamination, anoxic coastal zones, and conversion to greenhouse gases. In addition, while most fertilizer components are mined (such as phosphates), inorganic nitrogen is derived from the energy intensive conversion of gaseous nitrogen to ammonia. Thus, the addition of nitrogen fertilizer is typically the highest single input cost for many crops, and since its production is energy intensive, the cost is dependent on the price of energy (Rothstein, 2007. *Plant Cell* 19:2695-2699). With an increasing demand for food from an increasing human population, agriculture yields must be increased at the same time as dependence on applied fertilizers is decreased. Therefore, to minimize nitrogen loss, reduce environmental pollution, and decrease input cost, it is crucial to develop crop varieties with higher nitrogen use efficiency (Garnett et al., 2009. *Plant Cell Environ.* 32:1272-1283; Hirel et al., 2007. *J. Exp. Bot.* 58:2369-2387; Lea and Azevedo, 2007. *Ann. Appl. Biol.* 151:269-275; Masclaux-Daubresse et al., 2010. *Ann. Bot.* 105:1141-1157; Moll et al., 1982. *Agron. J.* 74:562-564; Sylvester-Bradley and Kindred, 2009. *J. Exp. Bot.* 60:1939-1951).

Improving Water Use Efficiency (WUE) to Improve Yield.

Freshwater is a limited and dwindling global resource; therefore, improving the efficiency with which food and biofuel crops use water is a prerequisite for maintaining and improving yield (Karaba et al., 2007. *Proc. Natl. Acad. Sci. USA.* 104:15270-15275). WUE can be used to describe the relationship between water use and crop productivity over a range of time integrals. The basic physiological definition of WUE equates the ratio of photosynthesis (A) to transpiration (T) at a given moment in time, also referred to as transpiration efficiency. However, the WUE concept can be scaled significantly, for example, over the complete lifecycle of a crop, where biomass or yield can be expressed per cumulative total of water transpired from the canopy. Thus far, the engineering of major field crops for improved WUE with single genes has not yet been achieved (Karaba et al., 2007. supra). Regardless, increased yields of wheat cultivars bred for increased transpiration efficiency (the ratio of photosynthesis to transpiration) have provided important support for the proposition that crop yield can be increased over broad acres through improvement in crop water-use efficiency (Condon et al., 2004. *J. Exp. Bot.* 55:2447-2460).

Estimates of water-use efficiency integrated over the life of plant tissues can be derived from analysis of the ratio of the $^{13}C$ carbon isotope to the $^{12}C$ carbon isotope in those tissues. The theory that underlies this means to estimating WUE is that during photosynthesis, incorporation of $^{13}C$ into the products of photosynthesis is slower than the lighter isotope $^{12}C$. Effectively, $^{13}C$ is discriminated against relative to $^{12}C$ during photosynthesis, an effect that is integrated over the life of the plant resulting in biomass with a distinct $^{13}C/^{12}C$ signature. Of the many steps in the photosynthetic process during which this discrimination occurs, discrimination at the active site of Rubisco is of most significance, a consequence of kinetic constraints associated with the $^{13}CO_2$ molecule being larger. Significantly, the discrimination by Rubisco is not constant, but varies depending on the $CO_2$ concentration within the leaf. At high $CO_2$ concentration discrimination by Rubisco is highest, however as $CO_2$ concentration decreases discrimination decreases. Because the $CO_2$ concentration within the leaf is overwhelmingly dependent on the balance between $CO_2$ influx through the stomatal pore and the rate of photosynthesis, and because the stomatal pore controls the rate of transpiration from the leaf, the $^{13}C/^{12}C$ isotopic signature of plant material provides an integrated record of the balance between transpiration and photosynthesis during the life of the plant and as such a surrogate measure of water-use efficiency (Farquhar et al. 1989. Annu. *Rev. Plant Physiol. Plant Mol. Biol.* 40:503-537).

With these needs in mind, new technologies for yield enhancement are required. In this disclosure, a phenotypic screening platform that directly measures photosynthetic capacity, water use efficiency, and nitrogen use efficiency of mature plants was used to discover advantageous properties conferred by ectopic expression of the described regulatory proteins in plants.

SUMMARY

The instant description is directed to a transgenic plant or plants that have increased photosynthetic resource use efficiency with respect to a control plant, or a plant part derived from such a plant, e.g., shoot vegetative organs/structures (e.g., leaves, stems and tubers), roots, flowers and floral organs/structures (e.g., bracts, sepals, petals, stamens, carpels, anthers and ovules), seed (including embryo, endosperm, and seed coat) and fruit (the mature ovary), plant tissue (e.g., vascular tissue, ground tissue, and the like), pulped, pureed, ground-up, macerated or broken-up tissue, and cells (e.g., guard cells, egg cells, etc.)). In this regard, the transgenic plant or plants comprise a recombinant polynucleotide comprising a promoter of interest. The choice of promoter may include a constitutive promoter or a promoter with enhanced activity in a tissue capable of photosynthesis (also referred to herein as a "photosynthetic promoter" or a "photosynthetic tissue-enhanced promoter") such as a leaf tissue or other green tissue. Examples of photosynthetic promoters include for example, an RBCS3 promoter, an RBCS4 promoter or others such as the At4g01060 (also referred to as "G682") promoter, the latter regulating expression in a guard cell. The promoter regulates a polypeptide that is encoded by the recombinant polynucleotide or by a second (or target) recombinant polynucleotide (in which case expression of the polypeptide may be regulated by a trans-regulatory element). The promoter may also regulate expression of a polypeptide to an effective level of expression in a photosynthetic tissue, that is, to a level that, as a result of expression of the polypeptide to that level, improves photosynthetic resource use efficiency in a transgenic plant relative to a control plant. The recombinant polynucleotide may comprise the promoter and also encode the polypeptide or alternatively, the polynucleotide may comprise the promoter and drive expression of the polypeptide that is encoded by the second recombinant polynucleotide. In an exemplary embodiment, the polypeptide comprises a sequence listed in the sequence listing, or a sequence that is homologous, paralogous or orthologous to said polypeptide, being structurally-related to said polypeptide and having a function similar to said polypeptide as described herein. Expression of the polypeptide under the regulatory control of the constitutive or leaf-enhanced or photosynthetic tissue-enhanced promoter in the transgenic plant confers greater photosynthetic resource use efficiency to the transgenic plants, and may ultimately increase yield that may be obtained from the plants.

The instant description also pertains to methods for increasing photosynthetic resource use efficiency in, or increasing yield from, a plant or plants including the method conducted by growing a transgenic plant comprising and/or transformed with an expression cassette comprising the recombinant polynucleotide that comprises a constitutive promoter or a promoter expressed in photosynthetic tissue, which may be a leaf-enhanced or green tissue-enhanced promoter, such as for example, the RBCS3, RBCS4, At4g01060, or another photosynthetic tissue-enhanced promoter. Examples of photosynthetic tissue-enhanced promoters are found in the Sequence Listing or in Table 22. The promoter regulates expression of a polypeptide that comprises a polypeptide listed in the Sequence Listing. Recombinant polynucleotides encoding these clade polypeptides are described in the following paragraphs (a)-(c), and exemplary polypeptides within the clade are described in the following paragraphs (d)-(f) and are shown in the instant sequence alignments and Figures.

The recombinant polynucleotide that is introduced into a transgenic plant may encode a listed polypeptide sequence or encodes a polypeptide that is phylogenetically-related to a listed polypeptide sequence, including sequences that include:

(a) nucleic acid sequences that are at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical to any of the listed polypeptides; and/or (b) nucleic acid sequences that encode polypeptide sequences that are at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical in their amino acid sequences to the entire length to any of the listed polypeptides; and/or (c) nucleic acid sequences that hybridize under stringent conditions (e.g., hybridization followed by one, by two, or by more than two wash steps of 6× saline-sodium citrate buffer (SSC) and 65° C. for ten to thirty minutes per step) to any of the listed polynucleotides.

The listed polypeptides and polypeptides member of their protein clade may include:

(d) polypeptide sequences encoded by the nucleic acid sequences of (a), (b) and/or (c); and/or (e) polypeptide sequences that have at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65f %, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% amino acid identity to any of the listed polypeptides, including SEQ ID NO: 2n, where n=1 to 241 (i.e., even integers 2, 4, 6, 8, . . . 482);

and/or at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65f%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100 amino acid identity to a conserved domain of any of the listed polypeptides, including SEQ ID NO: 483 to 841; and/or (f) polypeptide sequences that comprise a subsequence that are at least 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical to any of the consensus sequences provided in the Sequence Listing, including SEQ ID NO: 842 to 861.

Expression of these polypeptides in the transgenic plant may confer increased photosynthetic resource use efficiency relative to a control plant. The transgenic plant may be selected for increased photosynthetic resource use efficiency or greater yield relative to the control plant. The transgenic plant may also be crossed with itself, a second plant from the same line as the transgenic plant, a non-transgenic plant, a wild-type plant, or a transgenic plant from a different line of plants, to produce a transgenic seed.

The instant description also pertains to methods for producing and selecting a crop plant with a greater yield than a control plant, the method comprising producing a transgenic plant by introducing into a target plant a recombinant polynucleotide that comprises a promoter, such as a leaf- or photosynthetic tissue-enhanced promoter that regulates a polypeptide encoded by the recombinant polynucleotide or a second recombinant polynucleotide, wherein the polypeptide comprises a polypeptide listed in the Sequence Listing, or a member of a clades of polypeptides phylogenetically related to a polypeptide listed in the Sequence Listing. A plurality of the transgenic plants is then grown, and a transgenic plant is selected that produces greater yield or has greater photosynthetic resource use efficiency than a control plant. The expression of the polypeptide in the selected transgenic plant confers the greater photosynthetic resource use efficiency and/or greater yield relative to the control plant. Optionally, the selected transgenic plant may be crossed with itself, a second plant from the same line as the transgenic plant, a non-transgenic plant, a wild-type plant, or a transgenic plant from a different line of plants, to produce a transgenic seed. A plurality of the selected transgenic plants will generally have greater cumulative canopy photosynthesis than the canopy photosynthesis of an identical number of the control plants.

The transgenic plant(s) described herein and produced by the instantly described methods may also possess one or more altered traits that result in greater photosynthetic resource use efficiency. The altered trait may include: increased photosynthetic capacity, increased photosynthetic rate, a decrease in leaf chlorophyll content, a decrease in percentage of nitrogen in leaf dry weight, increased leaf transpiration efficiency, an increase in resistance to water vapor diffusion from the leaf exerted by stomata, an increased rate of relaxation of photoprotective reactions operating in the light harvesting antennae, a decrease in the ratio of the carbon isotope $^{12}C$ to $^{13}C$ in above-ground biomass, and/or an increase in the total dry weight of above-ground plant material.

At least one advantage of greater photosynthetic resource use efficiency is that the transgenic plant, or a plurality of the transgenic plants, will have greater cumulative canopy photosynthesis than the canopy photosynthesis of an identical number of the control plants, or produce greater yield than an identical number of the control plants. A wide variety of transgenic plants are envisioned, including corn, wheat, rice, *Setaria, Miscanthus*, switchgrass, ryegrass, sugarcane, miscane, barley, sorghum, turfgrass, soy, cotton, canola, rapeseed, *Crambe, Camelina*, sugar beet, alfalfa, tomato, *Eucalyptus*, poplar, willow, pine, birch and other woody plants.

The instant description also pertains to expression vectors that comprise a recombinant polynucleotide that comprises a promoter expressed in photosynthetic tissue, for example, a constitutive promoter, or a leaf- or green tissue-enhanced promoter including the RBCS3, RBCS4, or At4g01060 promoters, or another photosynthetic tissue-enhanced promoter, for example, such a promoter found in the Sequence Listing or in Table 22, and a subsequence that encodes a polypeptide comprising a polypeptide sequence provided in the Sequence Listing or a member of the polypeptide clades of the polypeptide sequences listed in the Sequence Listing, or, alternatively, two expression constructs, one of which encodes a promoter such as a constitutive promoter, or a leaf-enhanced promoter or other photosynthetic tissue-enhanced promoter, and the second encodes a polypeptide sequence provided in the Sequence Listing or a member of the polypeptide clades of the polypeptide sequences listed in the Sequence Listing. In either instance, whether the polypeptide is encoded by the first or second expression constructs, the promoter regulates expression of the polypeptide by being responsible for production of cis- or trans-regulatory elements, respectively. In some embodiments, the expression vectors or cassettes comprise a promoter of the present application, and a gene of interest, wherein the promoter and the gene of interest do not link to each other under natural conditions, e.g., the linkage between the promoter and the gene of interest does not exist in nature.

The instant description is also directed to a method for producing a monocot plant with increased grain yield by providing a monocot plant cell or plant tissue with stably integrated, exogenous, recombinant polynucleotide comprising a promoter (for example, a constitutive, a non-constitutive, an inducible, a tissue-enhanced, or a photosynthetic tissue-enhanced promoter) that is functional in plant cells and that is operably linked to an exogenous or an endogenous nucleic acid sequence that encodes a listed polypeptide, that is expressed in a photosynthetic tissue of the transgenic plant to a level effective in conferring greater photosynthetic resource use efficiency relative to a control plant that does not contain the recombinant polynucleotide. A plant is generated from the plant cell or the plant tissue that comprises the recombinant polynucleotide, the plant is then grown and an increase in photosynthetic resource use efficiency or grain yield is measured relative to the control plant.

In the above paragraphs, the control plant may be exemplified by a plant of the same species as the plant comprising the recombinant polynucleotide, but the control plant does not comprise the recombinant polynucleotide that encodes a listed polypeptide of interest.

BRIEF DESCRIPTION OF THE SEQUENCE LISTING AND DRAWINGS

The Sequence Listing provides exemplary polynucleotide and polypeptide sequences of the instant description. The traits associated with the use of the sequences are included in the Examples.

Incorporation of the Sequence Listing

The Sequence Listing provides exemplary polynucleotide and polypeptide sequences. The copy of the Sequence Listing being submitted electronically with this patent application under 37 CFR § 1.821-1.825, is a read-only memory computer-readable file in ASCII text format. The Sequence Listing is named "MPS-0216P_ST25.txt", the electronic file of the Sequence Listing was created on Oct. 2, 2013, and is (1,651,577 bytes in size (157 megabytes in size as measured in MS-WINDOWS). The Sequence Listing is herein incorporated by reference in its entirety.

In FIG. 1, a phylogenetic tree of ATMYB27 or AT3G53200 (also referred to as G1311) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. ATMYB27 (AT3G53200.1) appears in the rounded rectangle. An ancestral sequence of ATMYB27 and closely-related sequences is represented by the node of the tree indicated by the arrow "A" in FIG. 1. ATMYB27 clade members are considered those proteins that descended from ancestral sequence "A", including the exemplary sequences shown in this figure that are bounded by AT3G53200.1 and GSVIVT01033670001_VITVI.

FIGS. 2A-2D show an alignment of ATMYB27 and representative clade-related proteins. The alignment was generated with MUSCLE (3.8) with default parameters. SEQ ID NOs: appear in parentheses after each Gene Identifier (GID). The conserved first and second Myb domains appear in boxes in FIGS. 2A-2B and FIG. 2B, respectively (for which the consensus sequences are SEQ ID NOs 842 and 843).

Figure 3:
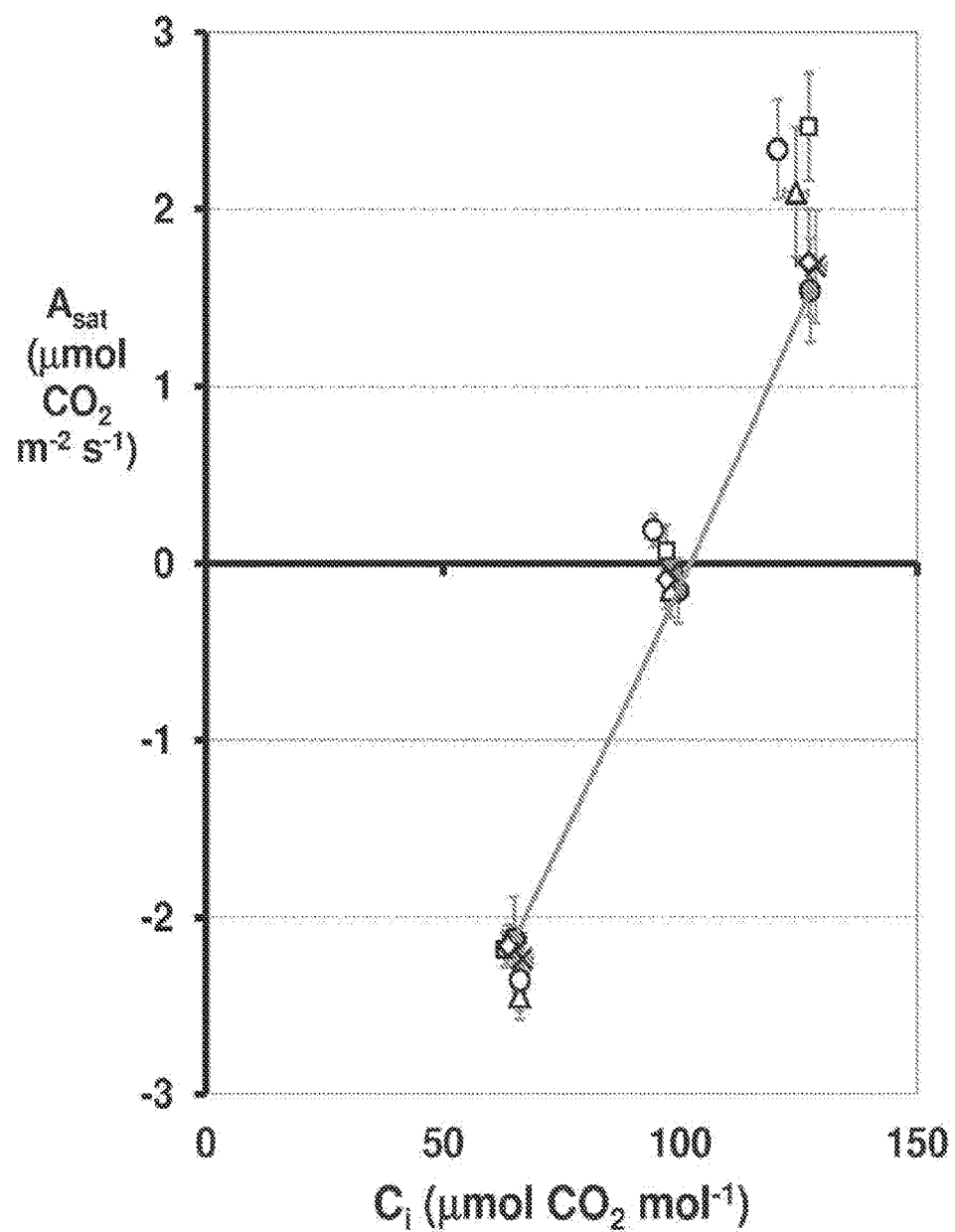

FIG. 3: Plot showing increased light saturated photosynthesis ($A_{sat}$) over a range of leaf sub-stomatal $CO_2$ concentration ($C_i$) in three ATMYB27 overexpression lines, compared to a control line. Data was collected over a range of $C_i$ over which the activity of Rubisco is known to limit $A_{sat}$. The solid line shown is a regression fitted to the data for the control line only. All data are the means±1 standard error for data collected on at least six replicate plants for each line.

Legend for FIG. 3:
- ● Control
- □ Line 1
- Δ Line 2
- X Line 4
- ◇ Line 5
- ○ Line 6

Figure 4:
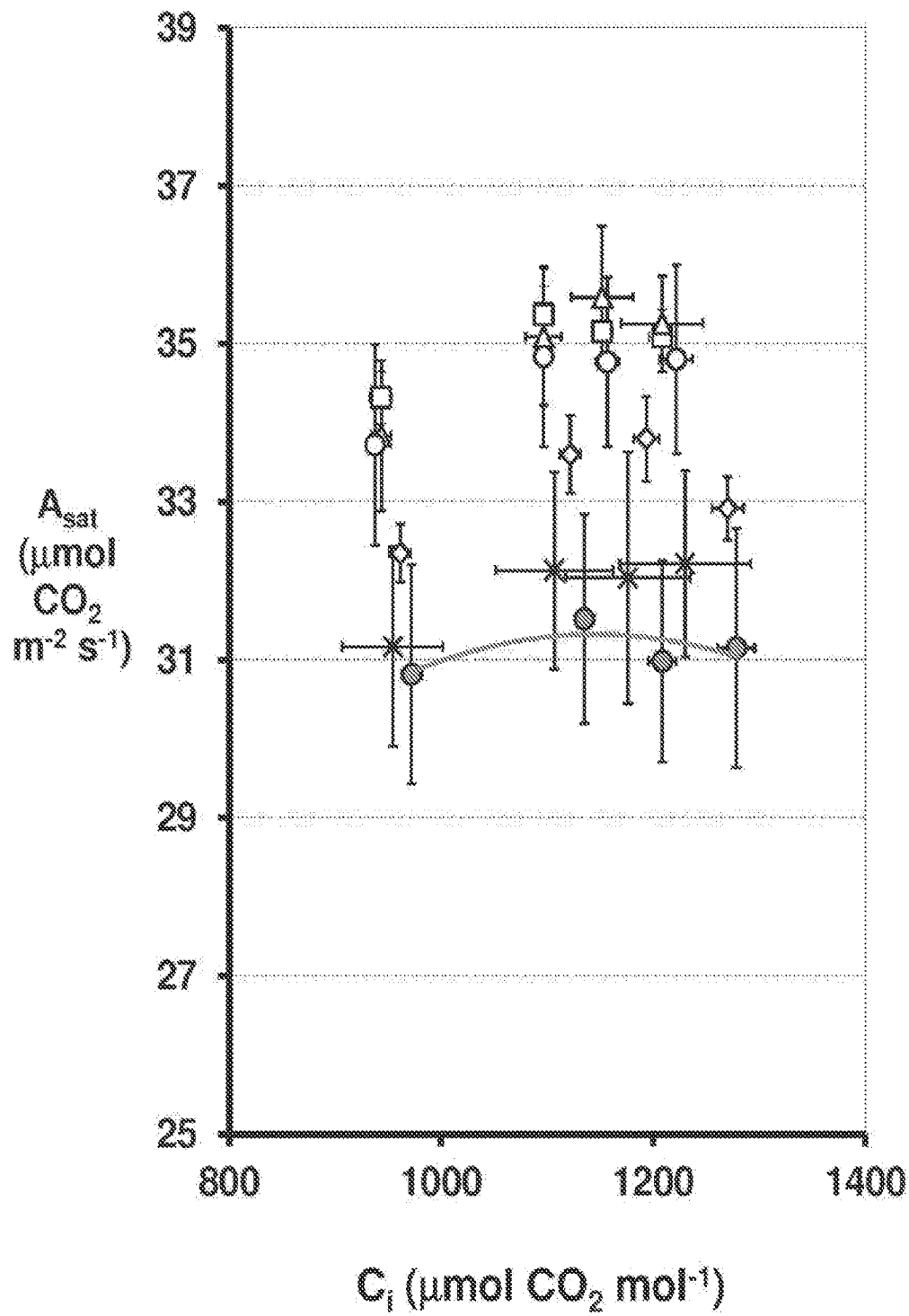

FIG. 4: Plot showing increased light saturated photosynthesis ($A_{sat}$) over a range of leaf sub-stomatal $CO_2$ concentration ($C_i$) in four ATMYB27 overexpression lines, compared to a control line. Data was collected over a range of $C_i$ over which the capacity to regenerate RuBP is known to limit $A_{sat}$. The solid line shown is a regression fitted to the data for the control line only. All data are the means±1 standard error for data collected on at least six replicate plants for each line.

Legend for FIG. 4:
- ● Control
- □ Line 1
- Δ Line 2
- X Line 4
- ◇ Line 5
- ○ Line 6

Figure 5A:
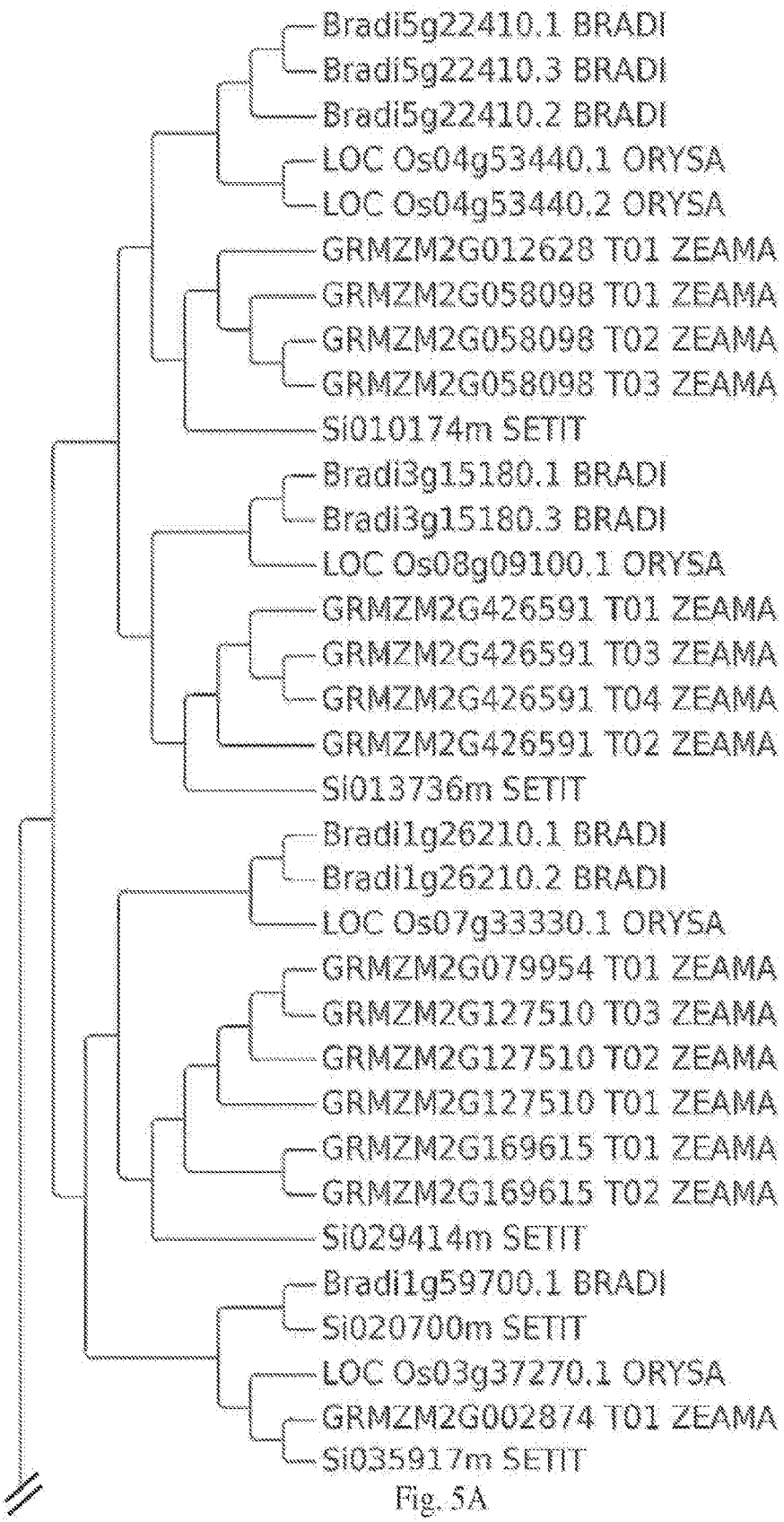
Figure 5B:
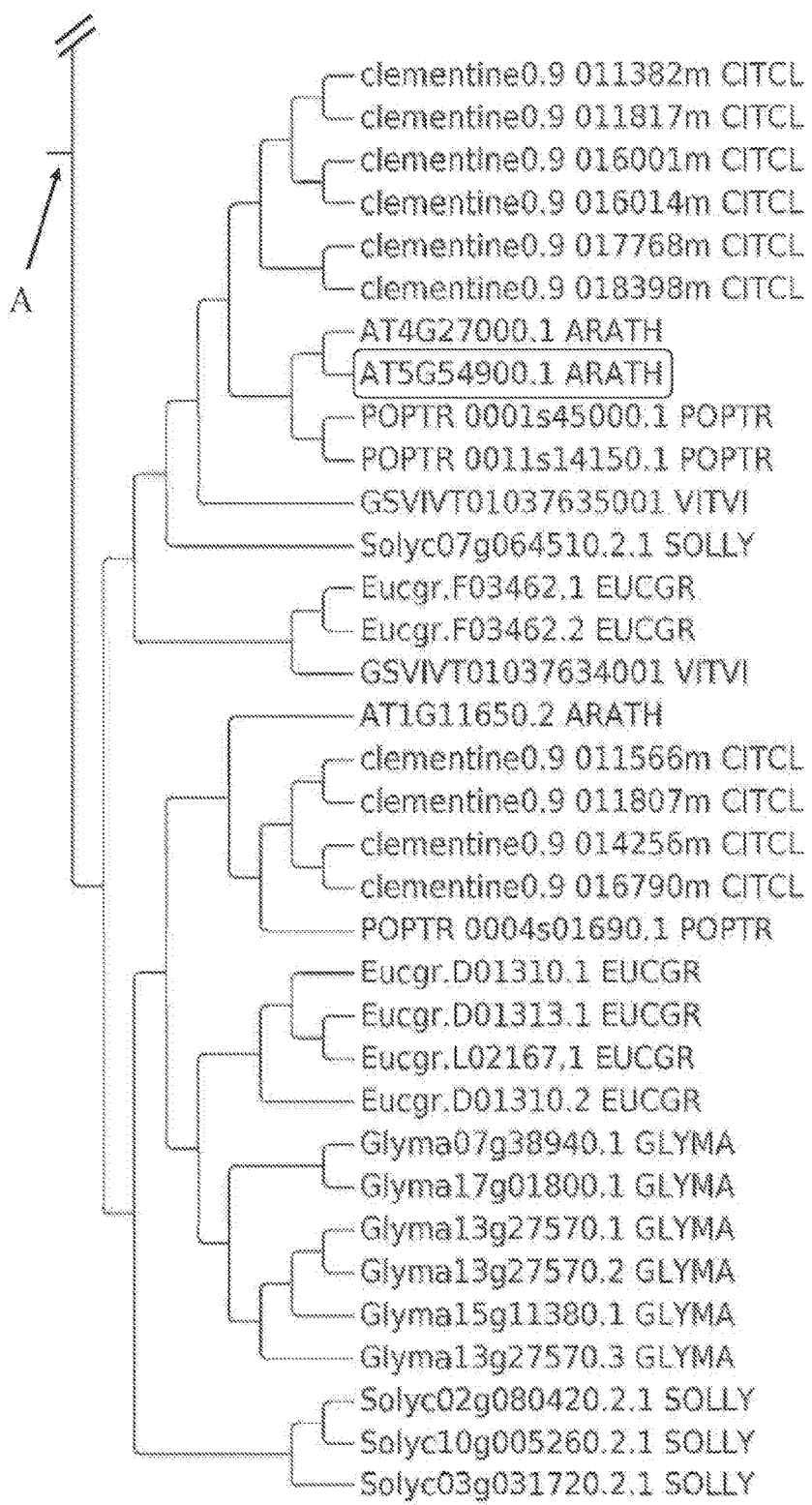

In FIGS. 5A and 5B, a phylogenetic tree of RPB45A or AT5G54900 (also referred to as G1940) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. RPB45A (AT5G54900.1) appears in the rounded rectangle in FIG. 5B. An ancestral sequence of RPB45A and closely-related sequences is represented by the node of the tree indicated by the arrow "A" in FIG. 5B. RPB45A clade members are considered those proteins that descended from ancestral sequence "A", including the exemplary sequences shown in this figure that are bounded by Bradi5g22410.1_BRADI and SolycO3g031720.2.1_SOLLY.

FIGS. 6A-6AF show an alignment of RPB45A and representative clade-related proteins. The alignment was generated with MUSCLE (3.8) with default parameters. SEQ ID NOs: appear in parentheses after each Gene Identifier (GID). The conserved first, second, and third RNA Recognition Motif (RRM) domains appear in boxes in FIGS. 6I-6N, FIGS. 6M-6R, and 6S-6X, respectively (for which the consensus sequences are SEQ ID NOs 844, 845 and 846, respectively).

Figure 7:
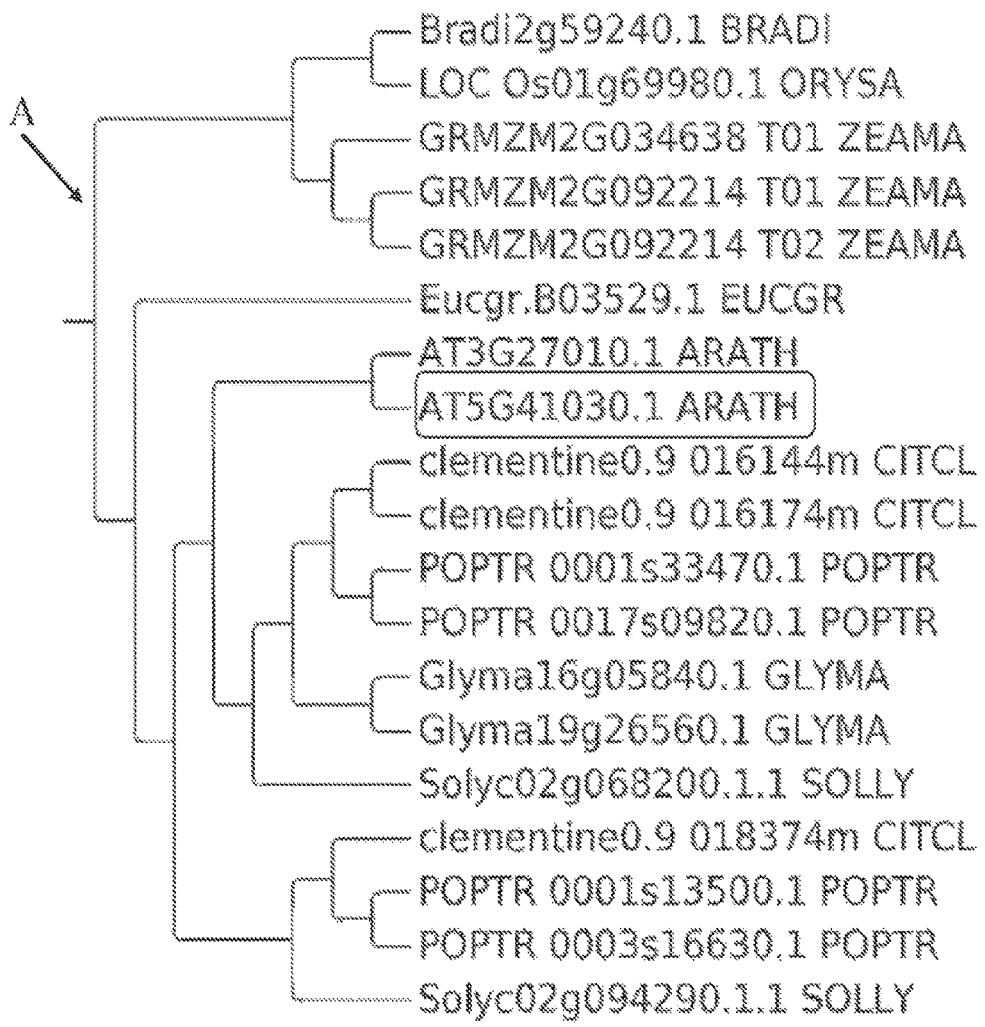

In FIG. 7, a phylogenetic tree of TCP6 or AT5G41030 (also referred to as G1936) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. TCP6 (AT5G41030.1) appears in the rounded rectangle. An ancestral sequence of TCP6 and closely-related sequences is represented by the node of the tree indicated by the arrow "A" in FIG. 7. TCP6 clade members are considered those proteins that descended from ancestral sequence "A", including the exemplary sequences shown in this figure that are bounded by Bradi2g59240.1_BRADI and Solyc02g094290.1.1_SOLLY.

FIGS. 8A-8L show an alignment of TCP6 and representative clade-related proteins. The alignment was generated with MUSCLE (3.8) with default parameters. SEQ ID NOs: appear in parentheses after each Gene Identifier (GID). The conserved TCP domain appears in boxes in FIGS. 8C-8E (for which the consensus sequence is SEQ ID NO 847).

Figure 9:
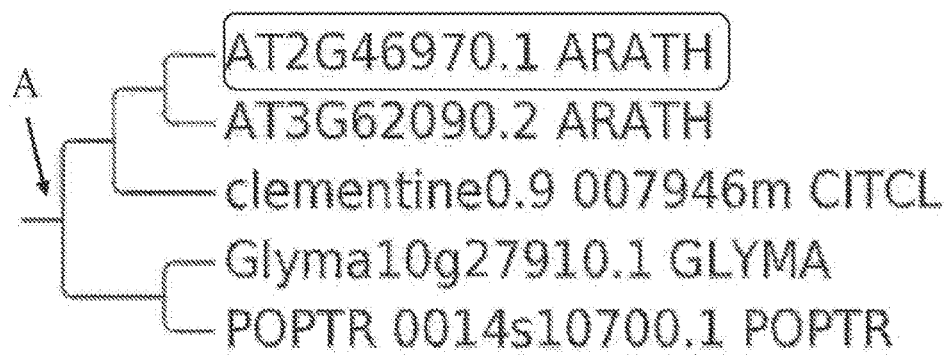

In FIG. 9, a phylogenetic tree of PIL1 or AT2G46970 (also referred to as G1649) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. The PIL1 clade members appear in the large box with the solid line boundary. PIL1 (AT2G46970.1) appears in the rounded rectangle. An ancestral sequence of PIL1 and closely-related sequences is represented by the node of the tree indicated by the arrow "A" in FIG. 9. PIL1 clade members are considered those proteins that descended from ancestral sequence "A", including the exemplary sequences shown in this figure that are bounded by AT2G46970.1_ARATH and POPTR_0014s10700.1_POPTR.

FIGS. 10A-10F show an alignment of PIL1 and representative clade-related proteins. The alignment was generated with MUSCLE (3.8) with default parameters. SEQ ID NOs: appear in parentheses after each Gene Identifier (GID). The conserved bHLH domain appears in boxes in FIGS. 10D-10E (for which the consensus sequence is SEQ ID NO 848).

Figure 11:
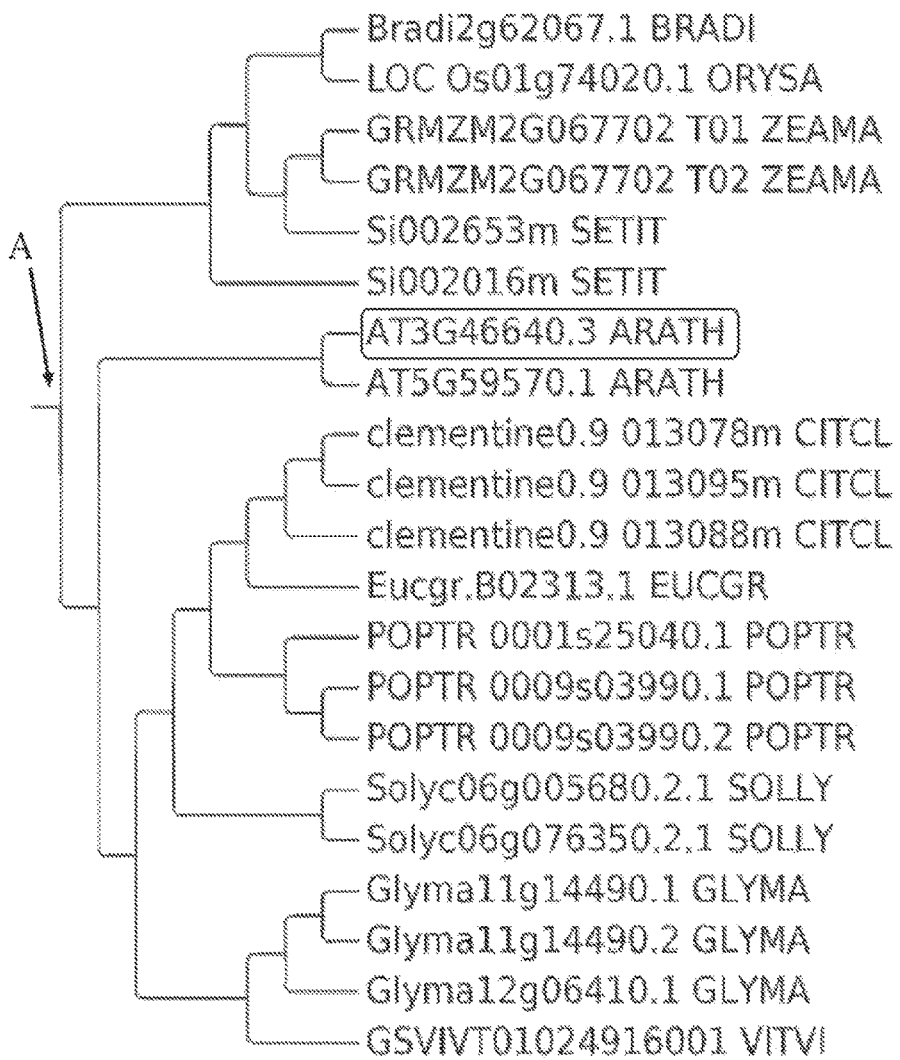

In FIG. 11, a phylogenetic tree of PCL1 or AT3G46640 (also referred to as G2741) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. PCL1 (AT3G46640.3) appears in the rounded rectangle. An ancestral sequence of PCL1 and closely-related sequences is represented by the node of the tree indicated by the arrow "A" in FIG. 11. PCL1 clade members are considered those proteins that descended from ancestral sequence "A", including the exemplary sequences shown in this figure that are bounded by Bradi2g62067.1_BRADI and GSVIVT01024916001_VITVI.

FIGS. 12A-12N show an alignment of PCL1 and representative clade-related proteins. The alignment was generated with MUSCLE (3.8) with default parameters. SEQ ID NOs: appear in parentheses after each Gene Identifier (GID). The conserved SANT (aka Myb-related or GARP) domain appears in boxes in FIGS. 12H-12I (for which the consensus sequence is SEQ ID NO 849).

Figure 13:
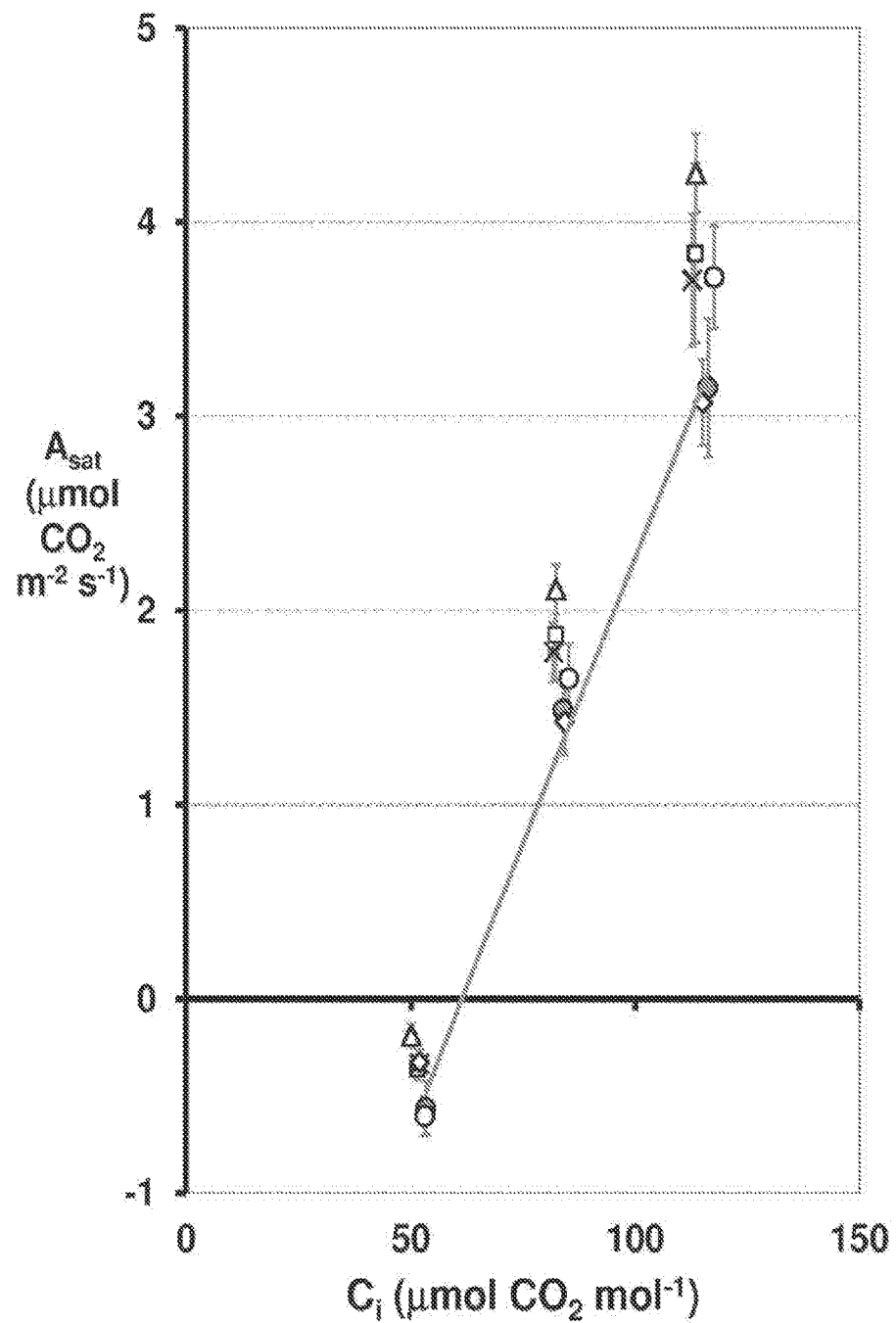

FIG. 13: Plot showing increased light saturated photosynthesis ($A_{sat}$) over a range of leaf sub-stomatal $CO_2$ concentration ($C_i$) in four PCL1 overexpression lines, compared to a control line. Data was collected over a range of $C_i$ where the activity of Rubisco is known to limit $A_{sat}$. The solid line shown is a regression fitted to the data for the control line only. All data are the means±1 standard error for data collected on at least seven replicate plants for each line.

Legend for FIG. 13:
- ⊙ Control
- □ Line 1
- Δ Line 2
- X Line 3
- ◇ Line 4
- ○ Line 5

Figure 14:
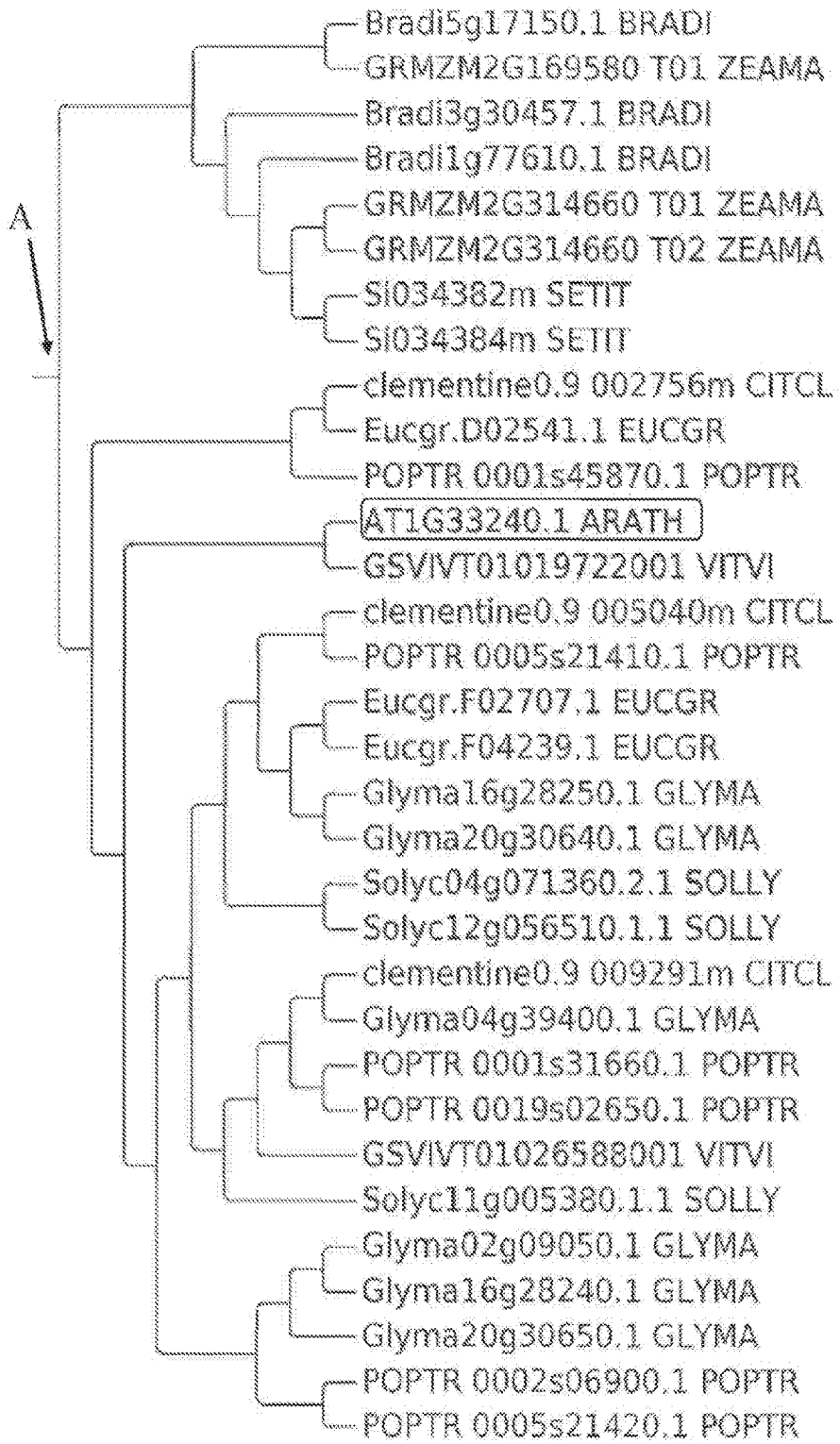

In FIG. 14, a phylogenetic tree of GTL1 or AT1G33240 (also referred to as G634) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. GTL1 (AT1G33240.1) appears in the rounded rectangle. An ancestral sequence of GTL1 and closely-related sequences is represented by the node of the tree indicated by the arrow "A" in FIG. 14. GTL1 clade members are considered those proteins that descended from ancestral sequence "A", including the exemplary sequences shown in this figure that are bounded by Bradi5g17150.1_BRADI and POPTR_0005s21420.1_POPTR.

FIGS. 15A-15X show an alignment of GTL1 and representative clade-related proteins. The sequence denoted G634_P77591 was the splice variant of GTL1 that was expressed in plants. The alignment was generated with MUSCLE (3.8) with default parameters. SEQ ID NOs: appear in parentheses after each Gene Identifier (GID). The conserved first and second trihelix (aka GT or Myb/SANT-related) domains appear in boxes in FIGS. 15C-15E and FIGS. 15O-15Q, respectively (for which the consensus sequences are SEQ ID NOs 850 and 851).

Figure 16:
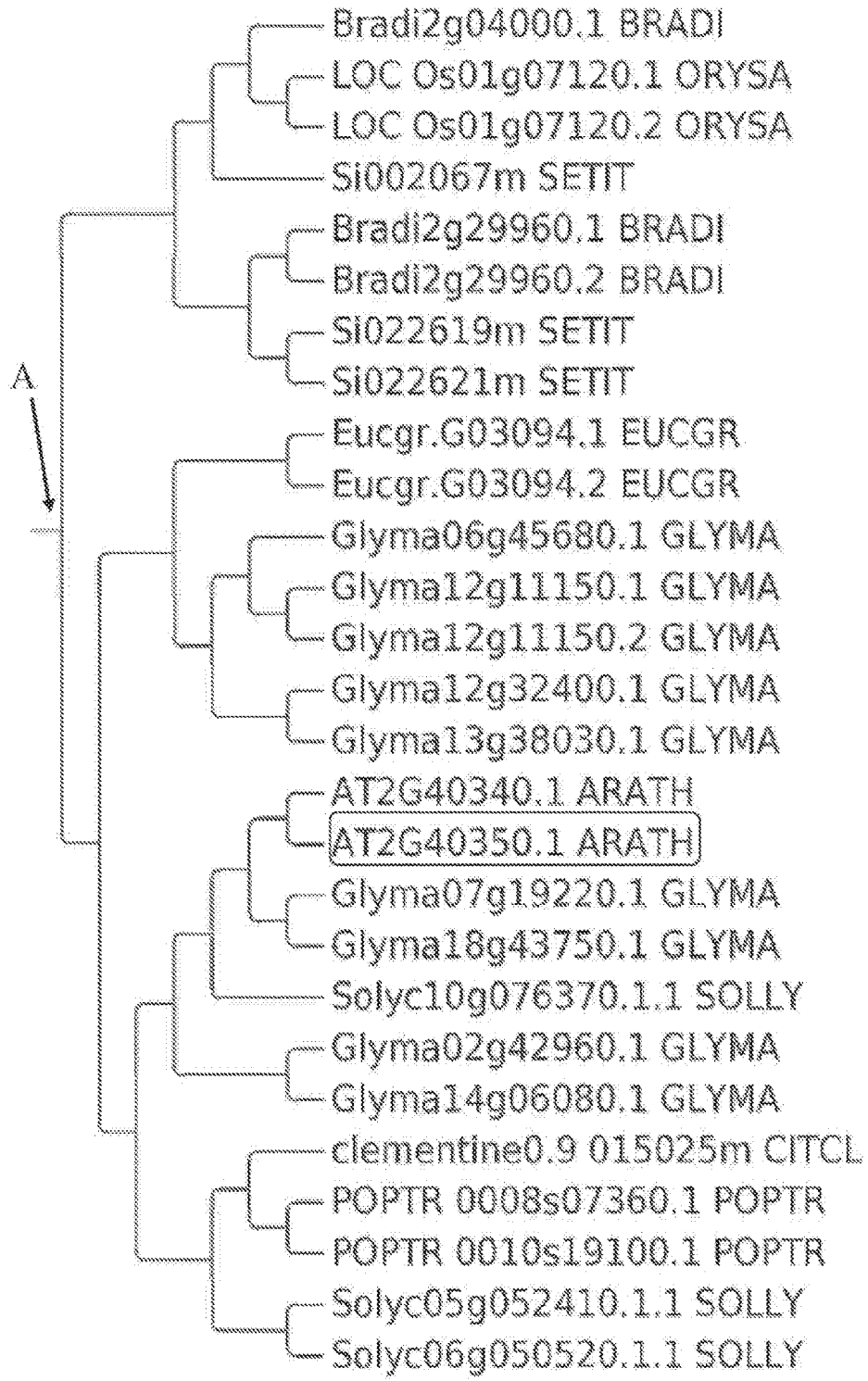

In FIG. 16, a phylogenetic tree of DREB2H or AT2G40350 (also referred to as G1755) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. DREB2H (AT2G40350.1) appears in the rounded rectangle. An ancestral sequence of DREB2H and closely-related sequences is represented by the node of the tree indicated by the arrow "A" in FIG. 16. DREB2H clade members are considered those proteins that descended from ancestral sequence "A", including the exemplary sequences shown in this figure that are bounded by Bradi2g04000.1_BRADI and Solyc06g050520.1.1_SOLLY.

FIGS. 17A-17N show an alignment of DREB2H and representative clade-related proteins. The sequence denoted G1755_P4407 was the sequence of the DREB2H clone expressed in plants. The alignment was generated with MUSCLE (3.8) with default parameters. SEQ ID NOs: appear in parentheses after each Gene Identifier (GID). The conserved AP2 domain appears in boxes in FIGS. 17E-17F (for which the consensus sequence is SEQ ID NO 852).

Figure 18:
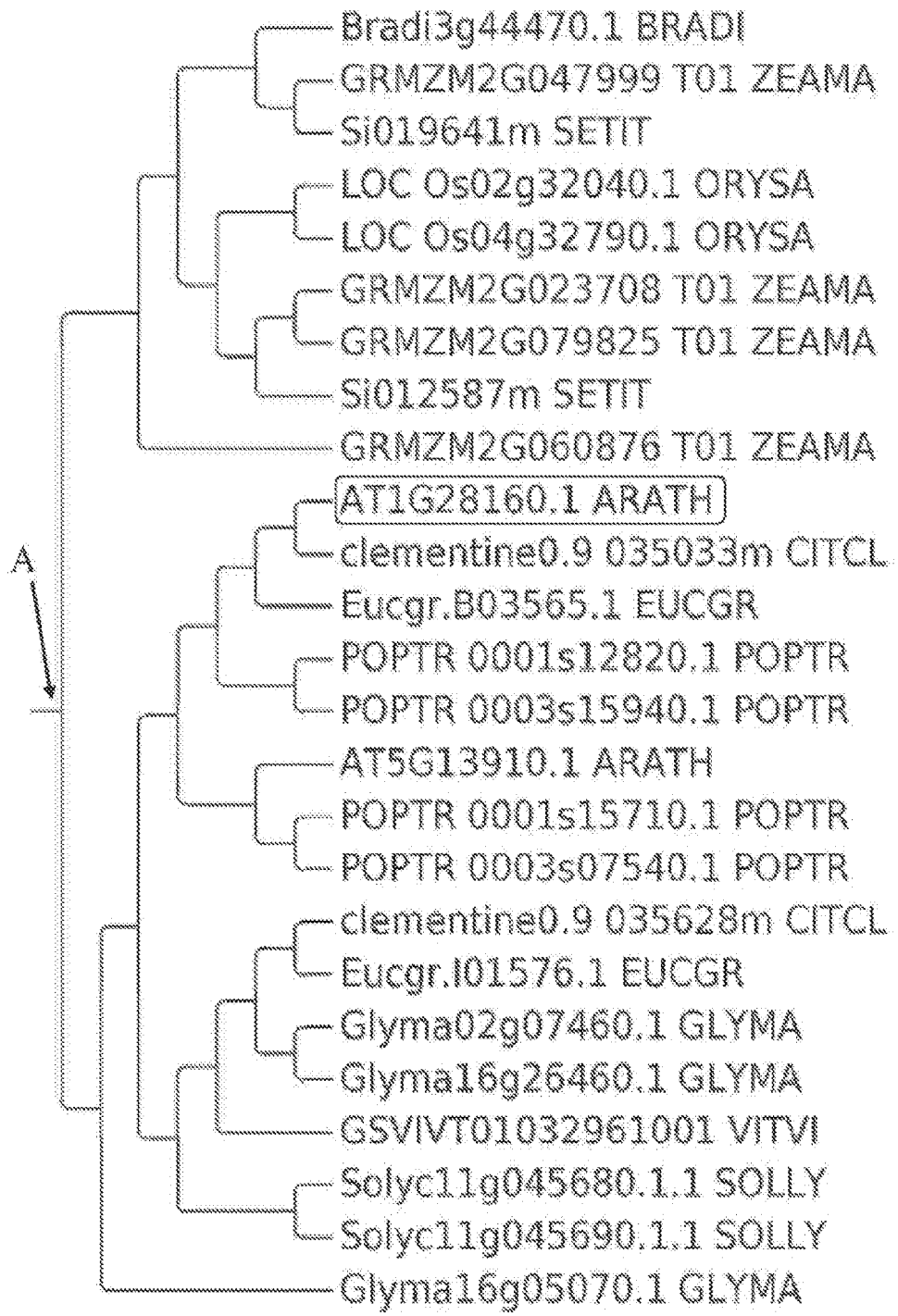

In FIG. 18, a phylogenetic tree of ERF087 or AT1G28160 (also referred to as G2292) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. ERF087 (AT1G28160.1) appears in the rounded rectangle. An ancestral sequence of ERF087 and closely-related sequences is represented by the node of the tree indicated by the arrow "A" in FIG. 18. ERF087 clade members are considered those proteins that descended from ancestral sequence "A", including the exemplary sequences shown in this figure that are bounded by Bradi3g44470.1_BRADI and Glyma16g05070.1_GLYMA.

FIGS. 19A-19J show an alignment of ERF087 and representative clade-related proteins. The alignment was generated with MUSCLE (3.8) with default parameters. SEQ ID NOs: appear in parentheses after each Gene Identifier (GID). The conserved AP2 domain appears in boxes in FIGS. 19C-19D, respectively (for which the consensus sequence is SEQ ID NO 853).

Figure 20:
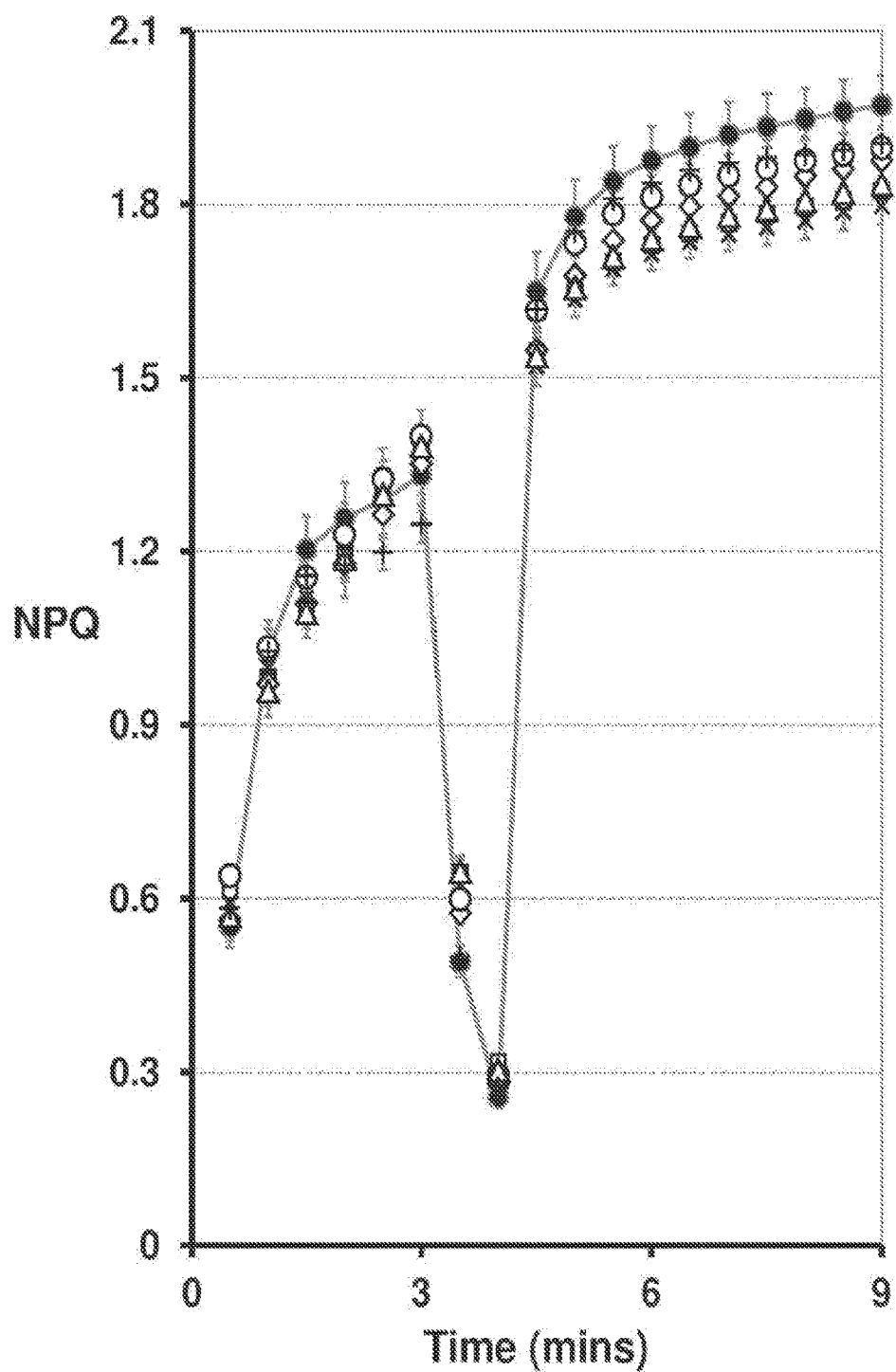

FIG. 20: Non-photochemical quenching (NPQ) dynamics at 22° C. Plot showing decreased NPQ in multiple ERF087 overexpression lines, during short term acclimation to high light. NPQ was calculated from an initial measurement of maximal, dark adapted fluorescence ($F_m$) and subsequent measurements of fluorescence made under varying incident light ($F_m$), as $NPQ=(F_m/F'_m)-1$. During the nine minute assay $F'_m$ was measured at 30 second intervals: initially after exposure to 700 μmol PAR $m^{-2}$ $s^{-1}$ beginning immediately after $F_m$ was measured; then, after a decrease to 0 μmol PAR $m^{-2}$ $s^{-1}$ after 3 minutes; then, after an increase to 2000 μmol PAR $m^{-2}$ $s^{-1}$ after 4 minutes. All symbols are the mean±1 standard error of measurements made on at least five replicate leaves for a given line (TAR' refers to photosynthetically active radiation).

Legend for FIG. 20:
- ⊙ Control
- □ Line 1
- ◇ Line 2
- X Line 3
- ○ Line 4
- Δ Line 5
- + Line 6

Figure 21:
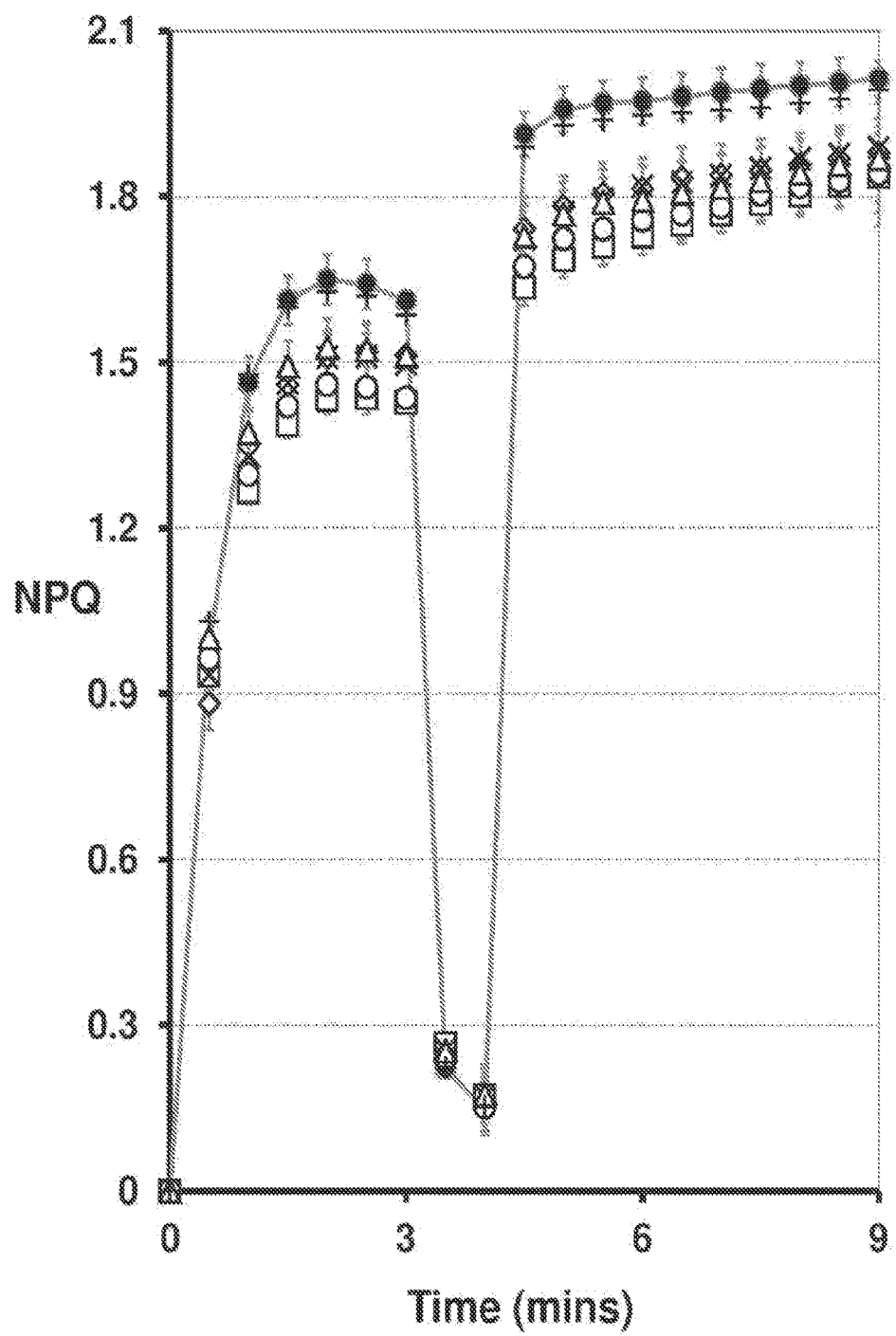

FIG. 21: Non-photochemical quenching (NPQ) dynamics at 35° C. Plot showing decreased NPQ in multiple ERF087 overexpression lines, during short term acclimation to high light. NPQ was calculated from an initial measurement of maximal, dark adapted fluorescence ($F_m$) and subsequent measurements of fluorescence made under varying incident light ($F'_m$), as NPQ=($F_m/F'_m$)−1. During the nine minute assay $F'_m$ was measured at 30 second intervals: initially after exposure to 700 µmol PAR $m^{-2}$ $s^{-1}$ beginning immediately after $F_m$ was measured; then, after a decrease to 0 µmol PAR $m^{-2}$ $s^{-1}$ after 3 minutes; then, after an increase to 2000 µmol PAR $m^{-2}$ $s^{-1}$ after 4 minutes. All symbols are the mean±1 standard error of measurements made on at least five replicate leaves for a given line.

Legend for FIG. 21:
- ● Control
- ☐ Line 1
- ◇ Line 2
- X Line 3
- ○ Line 4
- Δ Line 5
- + Line 6

Figure 22:
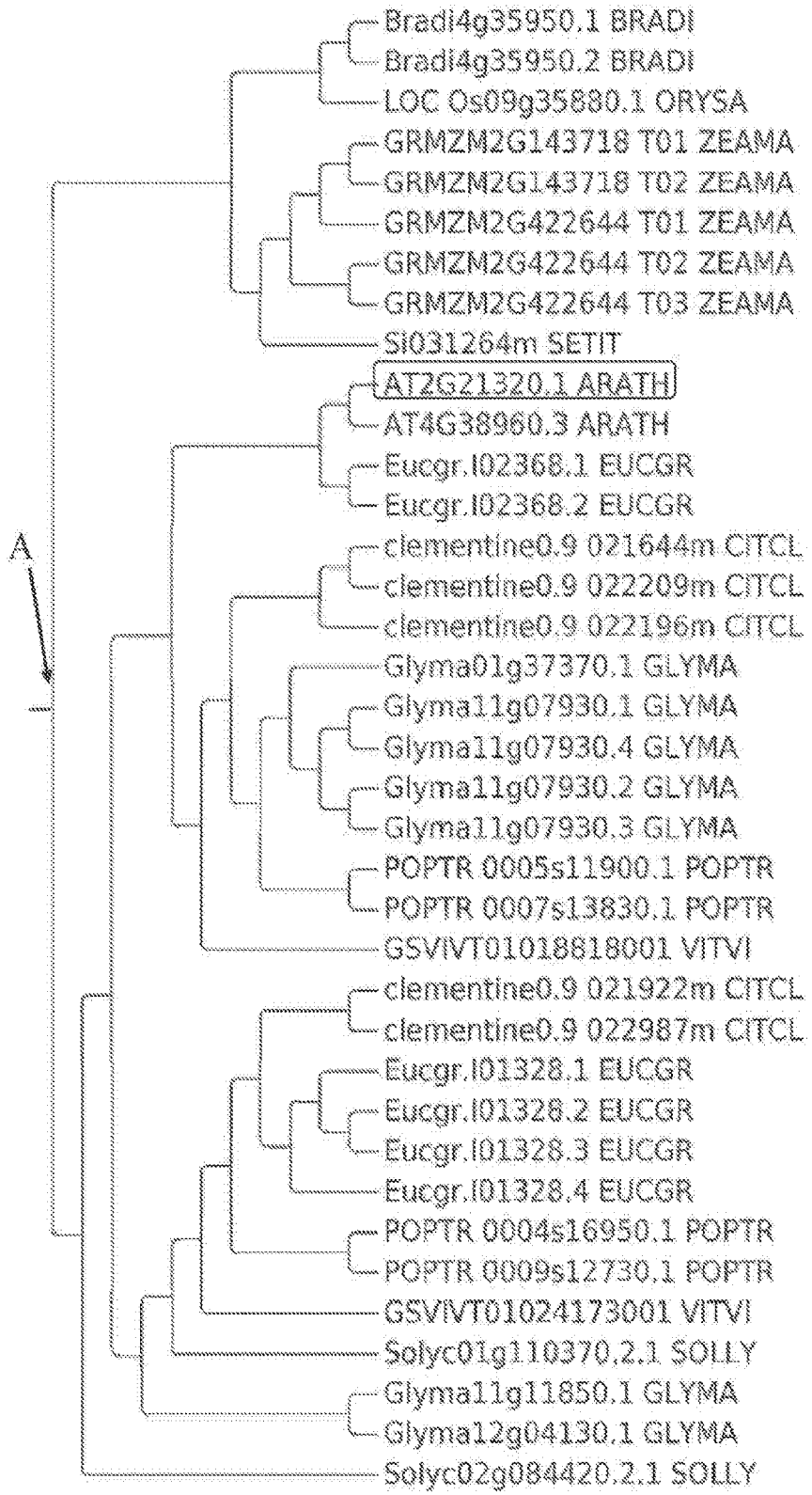

In FIG. 22, a phylogenetic tree of BBX18 or AT2G21320 (also referred to as G1881) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. BBX18 (AT2G21320.1) appears in the rounded rectangle. An ancestral sequence of BBX18 and closely-related sequences is represented by the node of the tree indicated by the arrow "A" in FIG. 22. BBX18 clade members are considered those proteins that descended from ancestral sequence "A", including the exemplary sequences shown in this figure that are bounded by Bradi4g35950.1_BRADI and Solyc02g084420.2.1_SOLLY.

FIGS. 23A-23G show an alignment of BBX18 and representative clade-related proteins. The alignment was generated with MUSCLE (3.8) with default parameters. SEQ ID NOs: appear in parentheses after each Gene Identifier (GID). The conserved first and second B-box domains appear in boxes in FIGS. 23A-23B and FIGS. 23B-23C, respectively (for which the consensus sequences are SEQ ID NOs 854 and 855).

Figure 24:
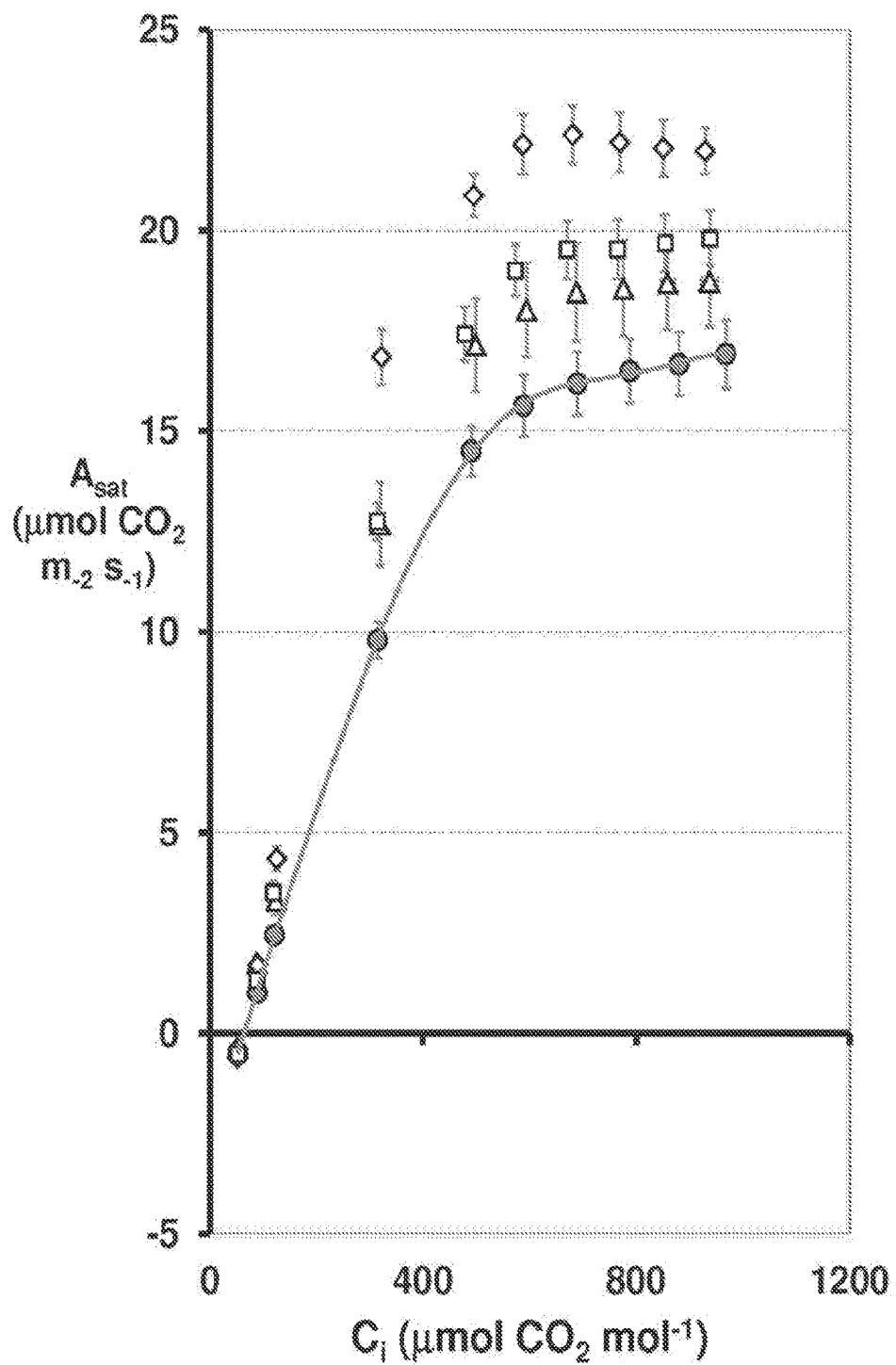

FIG. 24: Plot showing increased light saturated photosynthesis ($A_{sat}$) over a range of leaf sub-stomatal $CO_2$ concentration ($C_i$) in three BBX18 overexpression lines, compared to a control line. Data was collected over a range of $C_i$, from low, where the activity of Rubisco is known to limit $A_{sat}$, to high, where the capacity to regenerate RuBP limits $A_{sat}$. The solid line shown is a regression fitted to the data for the control line only. All data are the means±1 standard error for data collected on at least seven replicate plants for each line.

Legend for FIG. 24:
- ● Control
- Δ Line 4
- ◇ Line 5
- ☐ Line 6

Figure 25:
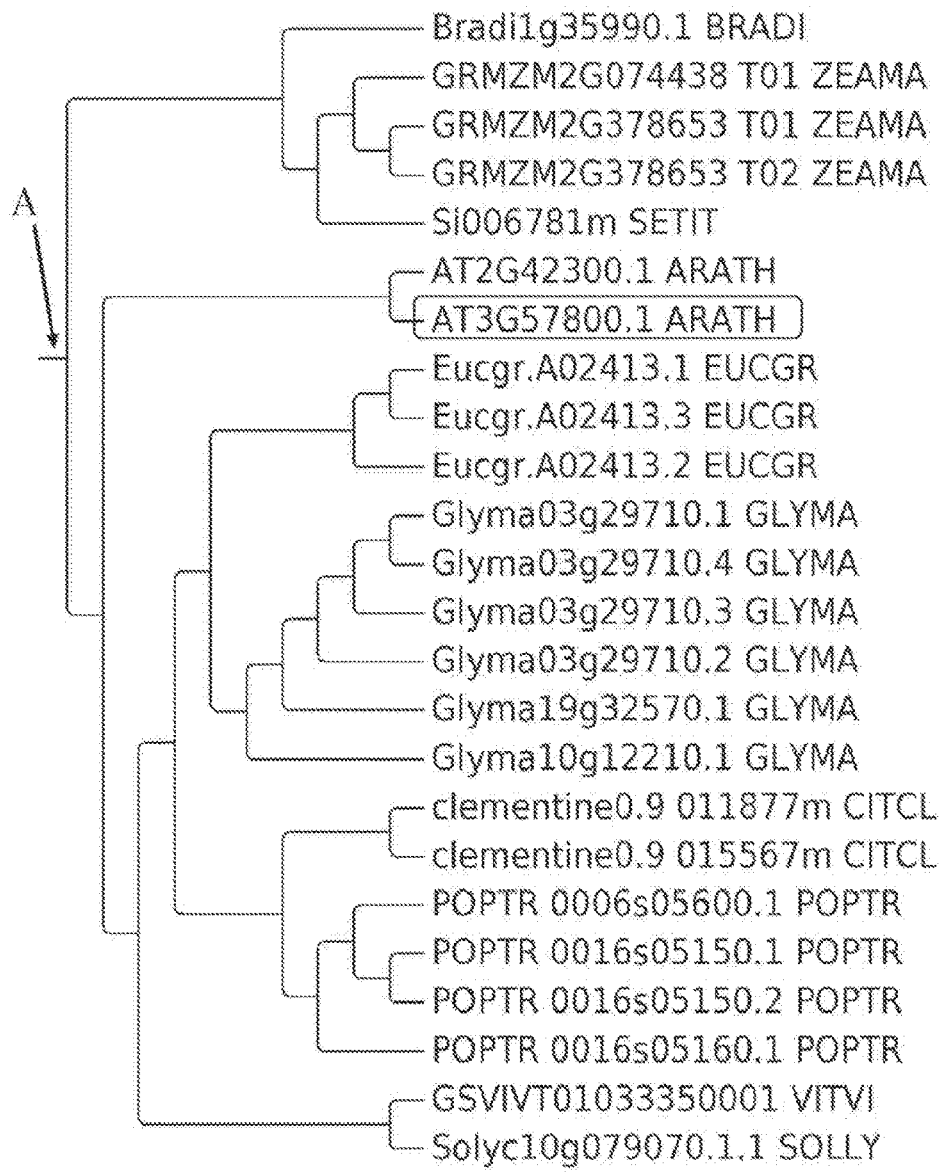

In FIG. 25, a phylogenetic tree of bHLH60 or AT3G57800 (also referred to as G2144) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. bHLH60 (AT3G57800.1) appears in the rounded rectangle. An ancestral sequence of bHLH60 and closely-related sequences is represented by the node of the tree indicated by the arrow "A" in FIG. 25. bHLH60 clade members are considered those proteins that descended from ancestral sequence "A", including the exemplary sequences shown in this figure that are bounded by Bradi1g35990.1_BRADI and Solyc10g079070.1.1_SOLLY.

FIGS. 26A-26N show an alignment of bHLH60 and representative clade-related proteins. The alignment was generated with MUSCLE (3.8) with default parameters. SEQ ID NOs: appear in parentheses after each Gene Identifier (GID). The conserved bHLH domain appears in boxes FIGS. 26H-26I (for which the consensus sequence is SEQ ID NO 856).

Figure 27:
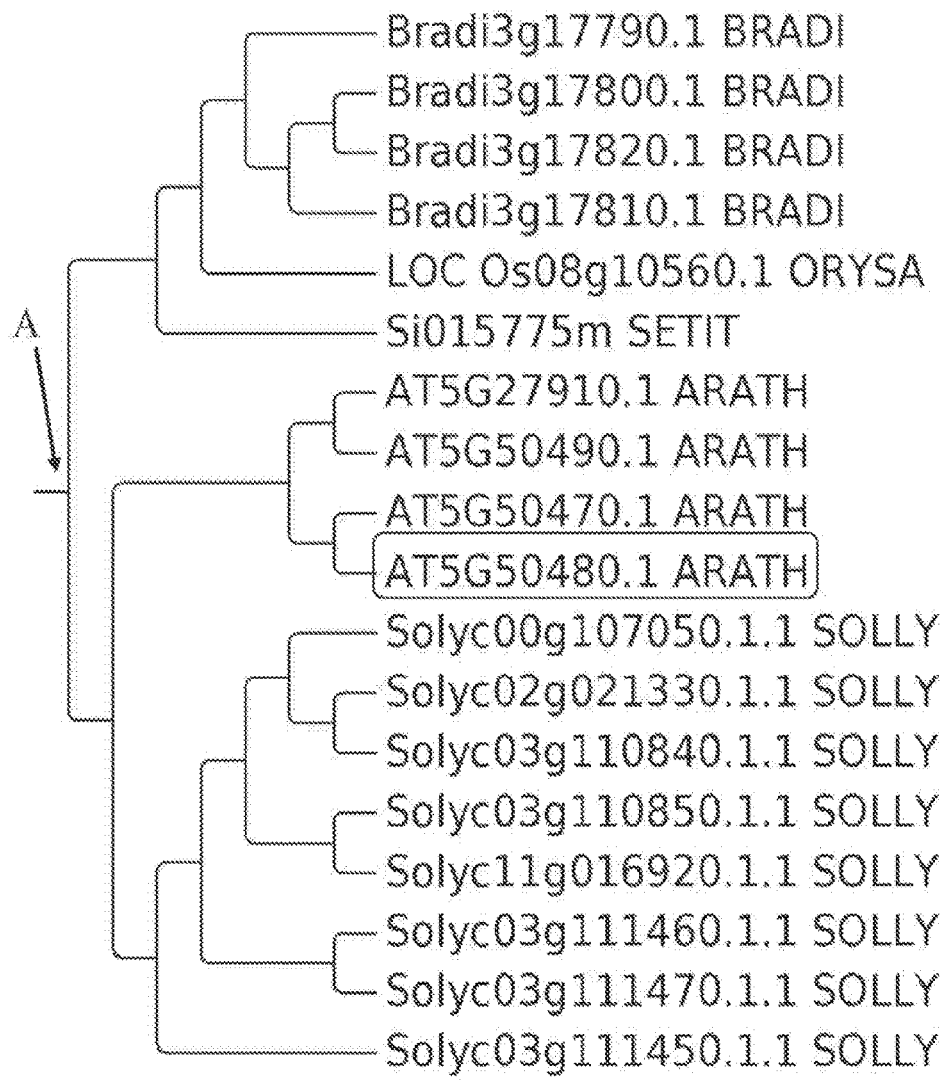

In FIG. 27, a phylogenetic tree of NF-YC6 or AT5G50480 (also referred to as G1820) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. NF-YC6 (AT5G50480.1) appears in the rounded rectangle. An ancestral sequence of NF-YC6 and closely-related sequences is represented by the node of the tree indicated by the arrow "A" in FIG. 27. NF-YC6 clade members are considered those proteins that descended from ancestral sequence "A", including the exemplary sequences shown in this figure that are bounded by Bradi3g17790.1_BRADI and SolycO3g111450.1.1_SOLLY.

FIGS. 28A-28T show an alignment of NF-YC6 and representative clade-related proteins. The alignment was generated with MUSCLE (3.8) with default parameters. SEQ ID NOs: appear in parentheses after each Gene Identifier (GID). The conserved NF-Y/histone-like domain appears in boxes in FIGS. 28J-28L (for which the consensus sequence is SEQ ID NO 857).

Figure 29:
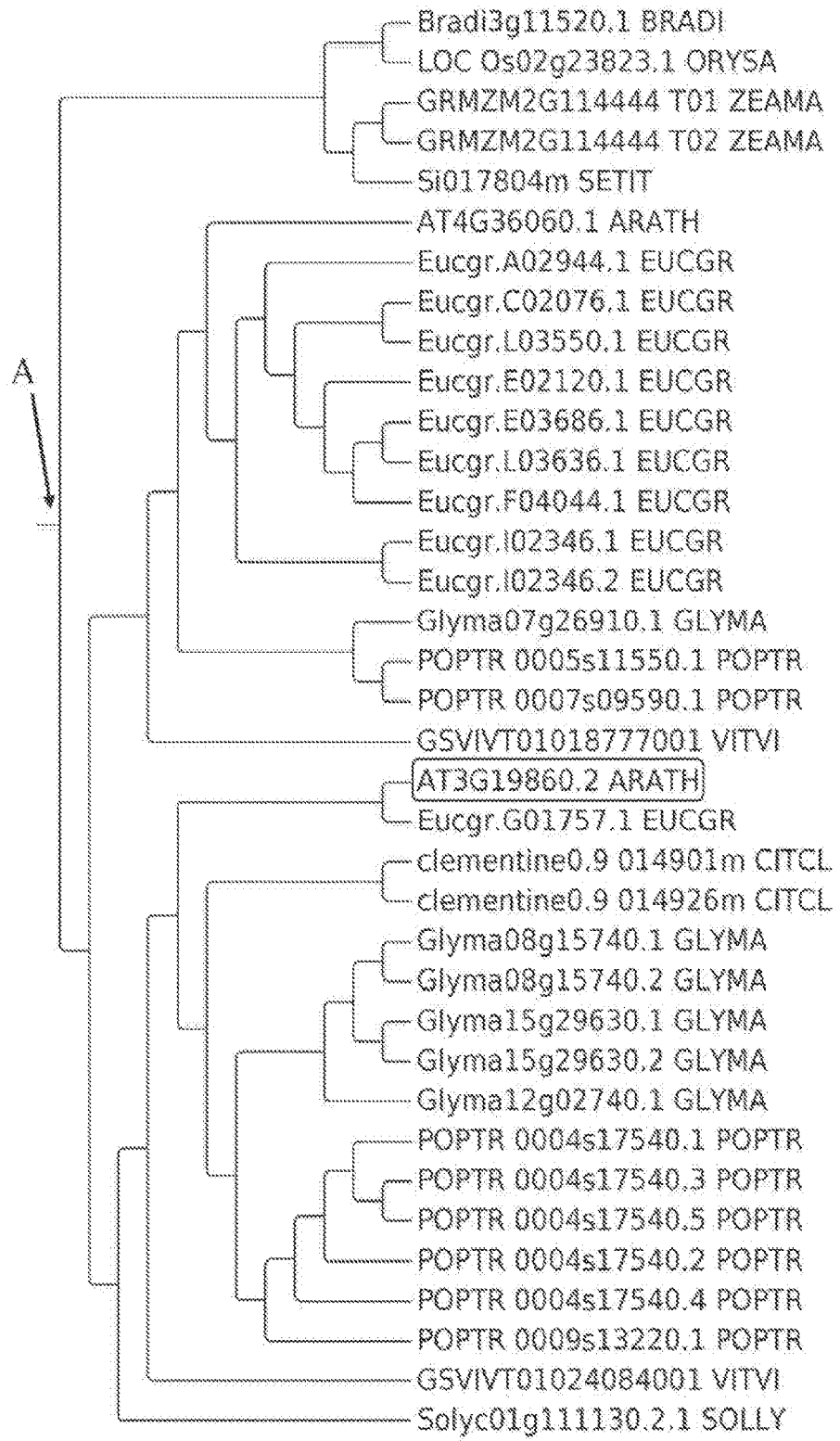

In FIG. 29, a phylogenetic tree of bHLH121 or AT3G19860 (also referred to as G782) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. bHLH121 (AT3G19860.2) appears in the rounded rectangle. An ancestral sequence of bHLH121 and closely-related sequences is represented by the node of the tree indicated by the arrow "A" in FIG. 29. bHLH121 clade members are considered those proteins that descended from ancestral sequence "A", including the exemplary sequences shown in this figure that are bounded by Bradi3g11520.1_BRADI and Solyc01g111130.2.1_SOLLY.

FIGS. 30A-30K show an alignment of bHLH121 and representative clade-related proteins. The alignment was generated with MUSCLE (3.8) with default parameters. SEQ ID NOs: appear in parentheses after each Gene Identifier (GID). The conserved bHLH domains appear in boxes in FIGS. 30B-30D, respectively (SEQ ID NO 858). A distinct putative leucine zipper motif and its consensus sequence that is found with these clade members comprising is found in FIG. 30D (SEQ ID NO: 859), enclosed in a dotted line box.

Figure 31:
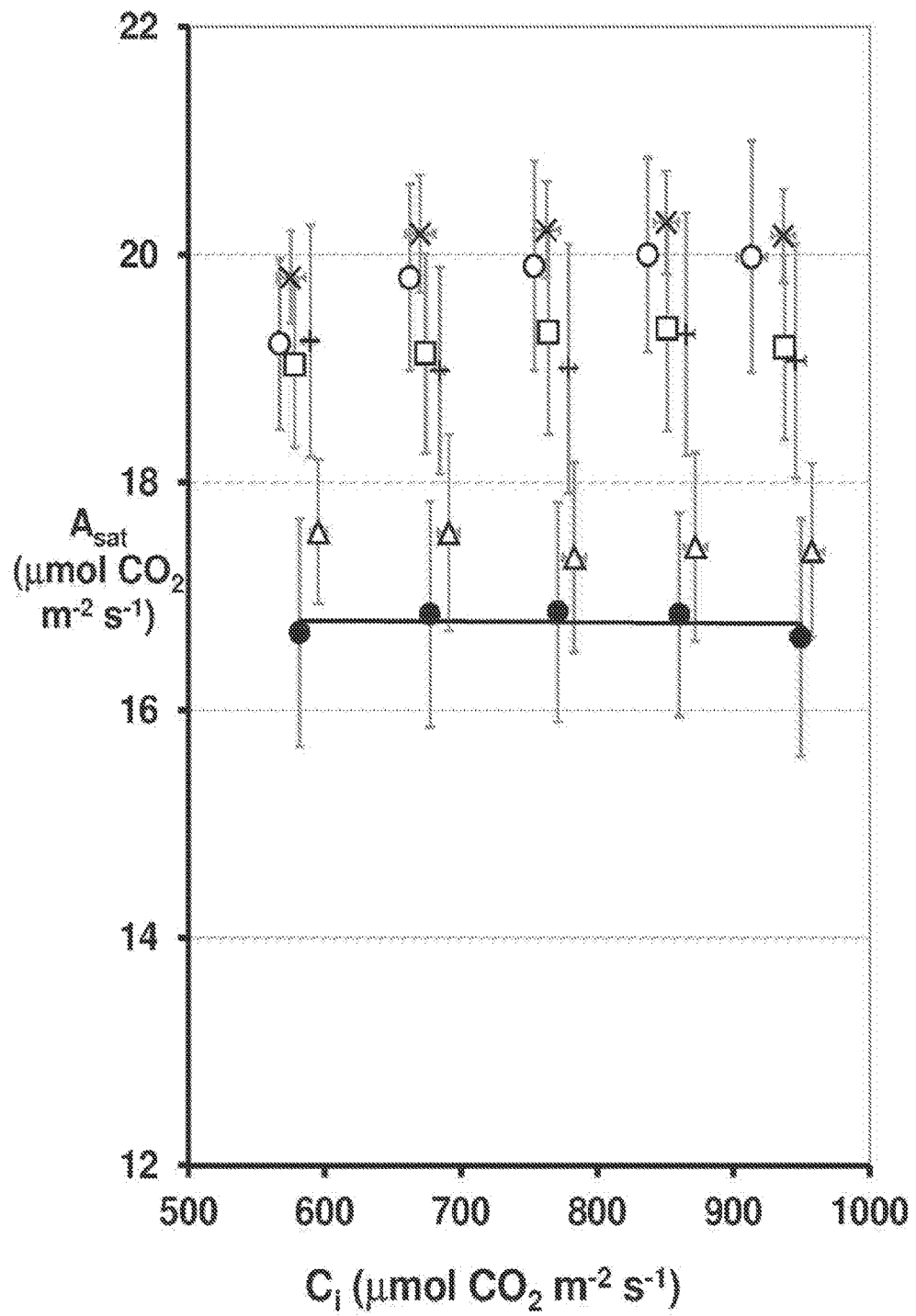

FIG. 31: Plot showing increased light saturated photosynthesis ($A_{sat}$) over a range of leaf sub-stomatal $CO_2$ concentration ($C_i$) in four out of five bHLH121 overexpression lines, compared to a control line. Data was collected over a range of $C_i$ over which the capacity to regenerate RuBP is known to limit $A_{sat}$. The solid line shown is a regression fitted to the data for the control line only. All data are the means±1 standard error for data collected on at least five replicate plants for each line.

Legend for FIG. 31:
- ⊙ Control
- + Line 1
- Δ Line 2
- □ Line 3
- ○ Line 4
- X Line 5

Figure 32:
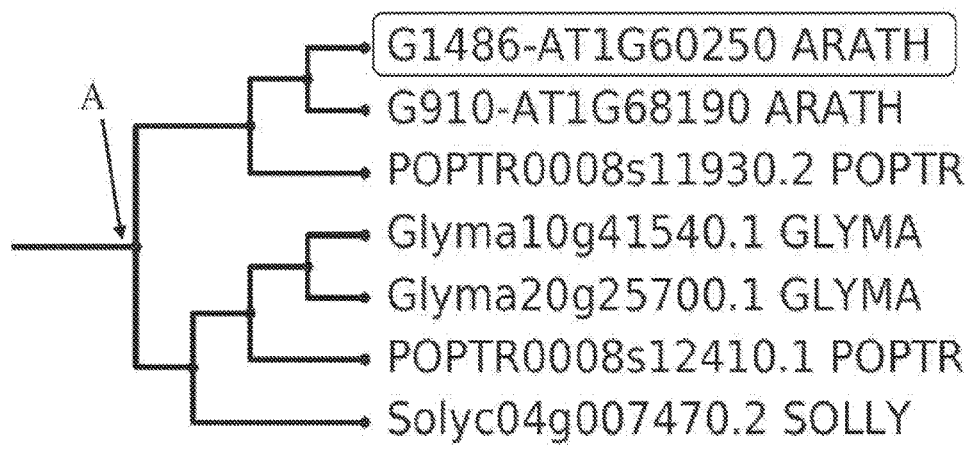

In FIG. 32, a phylogenetic tree of BBX26 or AT1G60250 (also referred to as G1486) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. BBX26 (AT1G60250) appears in the rounded rectangle. An ancestral sequence of BBX26 and closely-related sequences is represented by the node of the tree indicated by the arrow "A" in FIG. 32. BBX26 clade members are considered those proteins that descended from ancestral sequence "A", including the exemplary sequences shown in this figure that are bounded by AT3G53200 ARATH and Solyc04007470.2 SOLLY.

FIGS. 33A-33E show an alignment of BBX26 and representative clade-related proteins. The alignment was generated with MUSCLE (3.8) with default parameters. SEQ ID NOs: appear in parentheses after each Gene Identifier (GID). The conserved B-box domain appears in boxes in FIG. 33A (for which the consensus sequence is SEQ ID NO 860).

Figure 34:
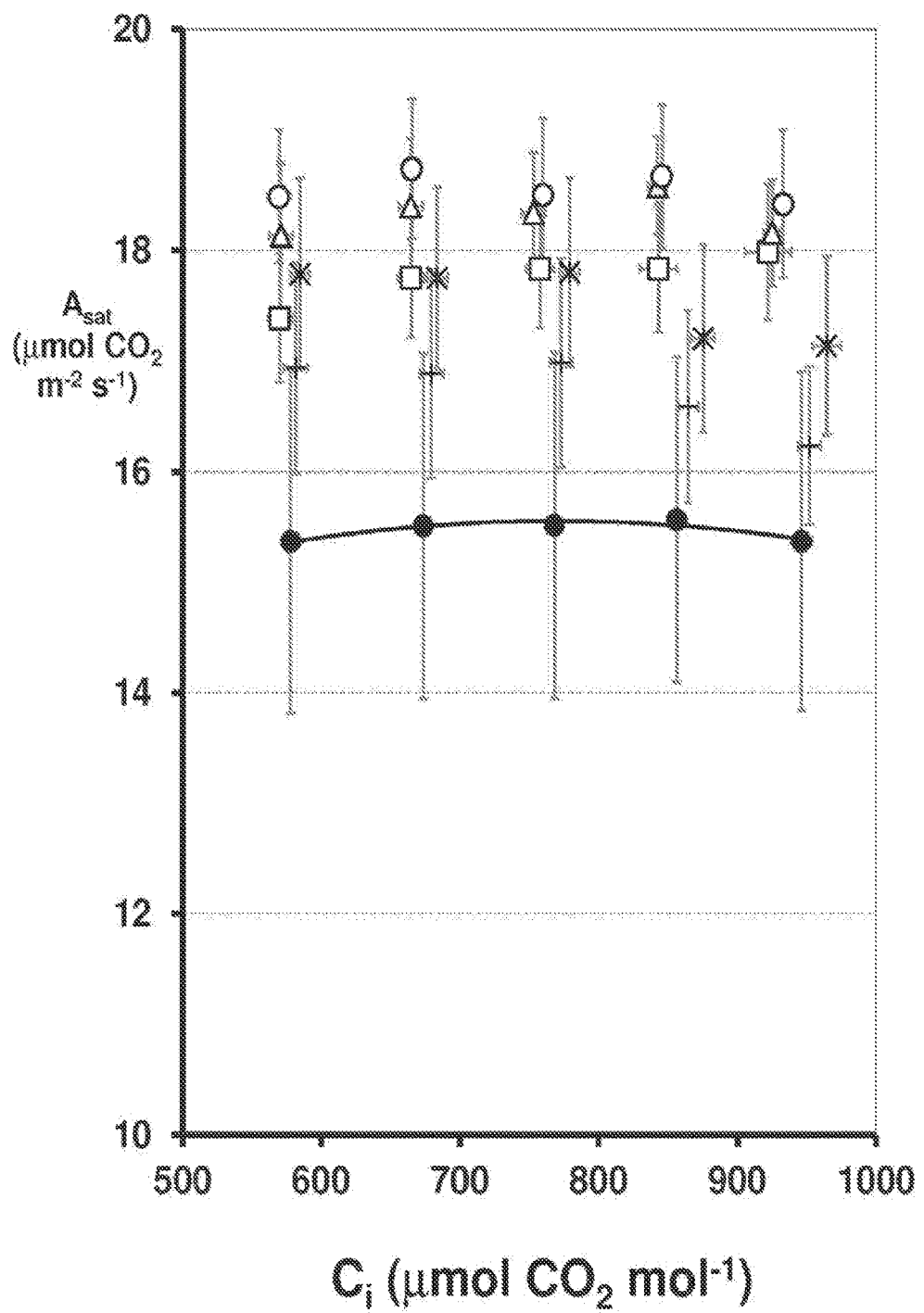

FIG. 34: Plot showing increased light saturated photosynthesis ($A_{sat}$) over a range of leaf sub-stomatal $CO_2$ concentration ($C_i$) in four BBX26 overexpression lines, compared to a control line. Data was collected over a range of $C_i$ over which the capacity to regenerate RuBP is known to limit $A_{sat}$. The solid line shown is a regression fitted to the data for the control line only. All data are the means±1 standard error for data collected on at least six replicate plants for each line.

Legend for FIG. 34:
- ⊙ Control
- * Line 1
- + Line 2
- ○ Line 3
- Δ Line 4
- □ Line 5

Figure 35A:
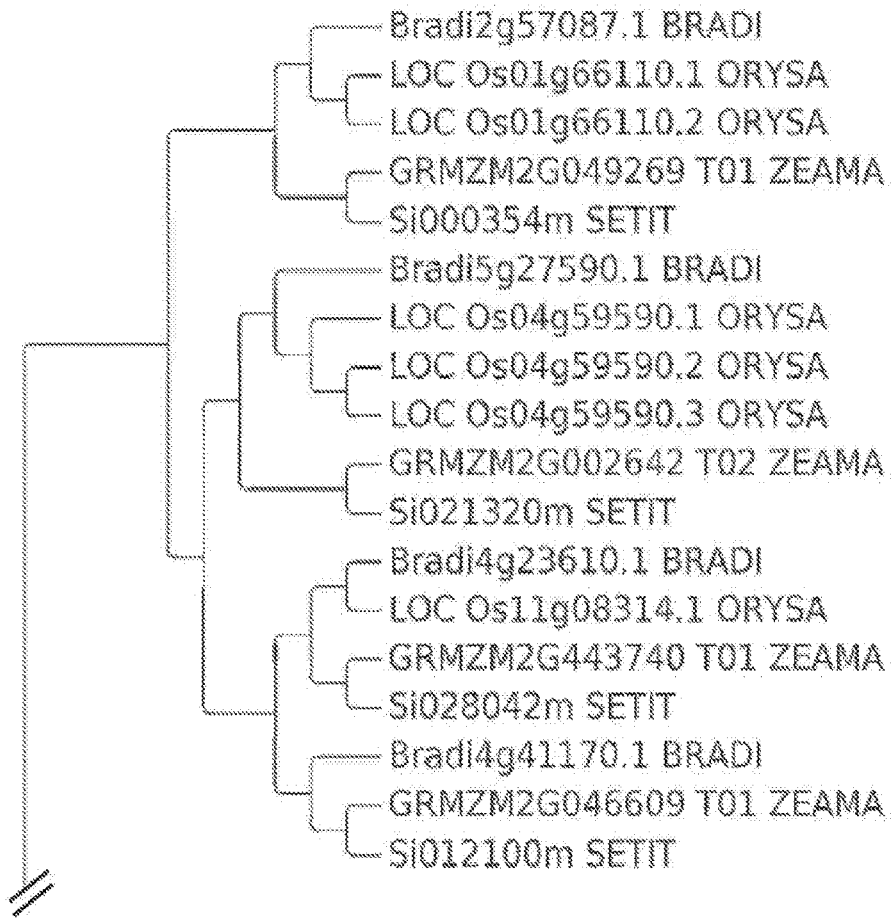
Figure 35B:
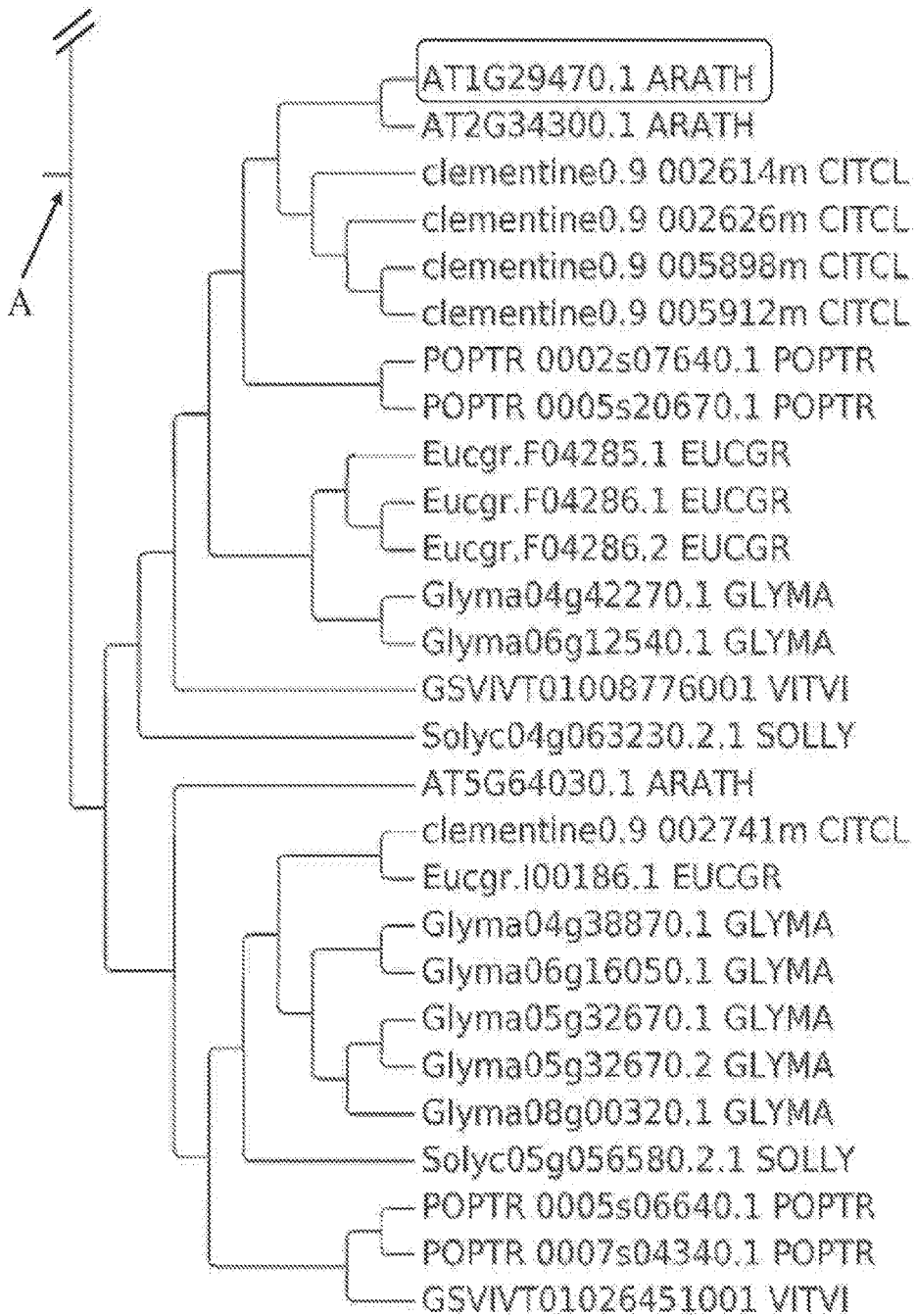

In FIGS. 35A and 35B, a phylogenetic tree of PMT24 or AT1G29470 (also referred to as G837) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. PMT24 (AT1G29470.1) appears in the rounded rectangle in FIG. 35B. An ancestral sequence of PMT24 and closely-related sequences is represented by the node of the tree indicated by the arrow "A" in FIG. 35B. PMT24 clade members are considered those proteins that descended from ancestral sequence "A", including the exemplary sequences shown in this figure that are bounded by Bradi2g57087.1_BRADI and GSVIVT01026451001_VITVI.

FIGS. 36A-36X show an alignment of PMT24 and representative clade-related proteins. The alignment was generated with MUSCLE (3.8) with default parameters. SEQ ID NOs: appear in parentheses after each Gene Identifier (GID). The conserved putative methyltransferase domain appears in boxes in FIGS. 36M-36S (for which the consensus sequence is SEQ ID NO 861).

Figure 37:
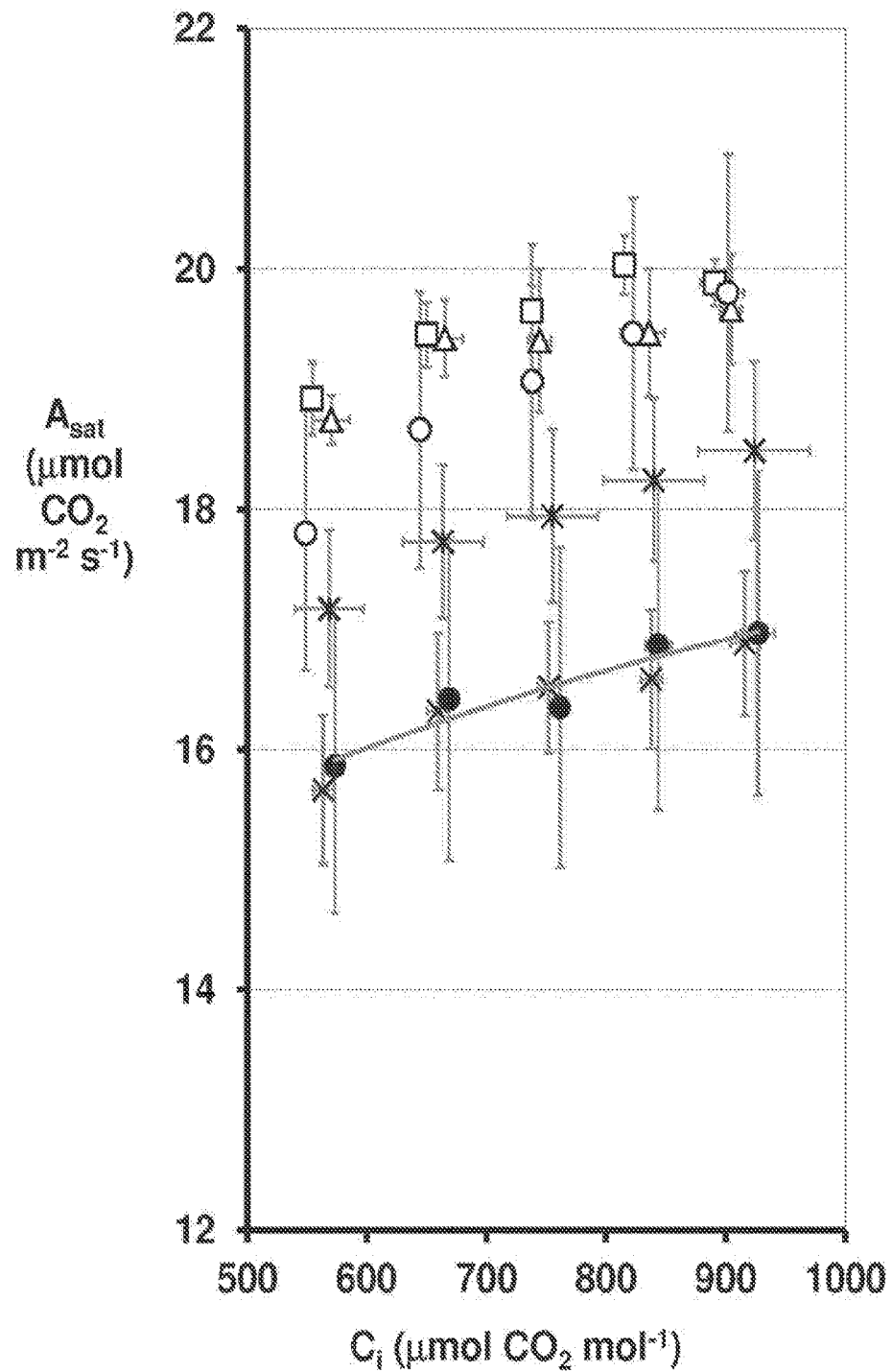

FIG. 37: Plot showing increased light saturated photosynthesis ($A_{sat}$) over a range of leaf sub-stomatal $CO_2$ concentration ($C_i$) in four out of five PMT24 overexpression lines, compared to a control line. Data was collected over a range of $C_i$ over which the capacity to regenerate RuBP is known to limit $A_{sat}$. The solid line shown is a regression fitted to the data for the control line only. All data are the means±1 standard error for data collected on at least five replicate plants for each line.

Legend for FIG. 37:
- ⊙ Control
- □ Line 3
- ○ Line 4
- X Line 5
- Δ Line 6
- * Line 7

DETAILED DESCRIPTION

The present description relates to polynucleotides and polypeptides for modifying phenotypes of plants, particularly those associated with increased photosynthetic resource use efficiency and increased yield with respect to a control plant. Throughout this disclosure, various information sources are referred to and/or are specifically incorporated. The information sources include scientific journal articles, patent documents, textbooks, and internet entries. While the reference to these information sources clearly indicates that they can be used by one of skill in the art, each and every one of the information sources cited herein are specifically incorporated in their entirety, whether or not a specific mention of "incorporation by reference" is noted. The contents and teachings of each and every one of the information sources can be relied on and used to make and use embodiments of the instant description.

As used herein and in the appended claims, the singular forms "a", "an", and "the" include the plural reference unless the context clearly dictates otherwise. Thus, for example, a reference to "a host cell" includes a plurality of such host cells, and a reference to "a plant" is a reference to one or more plants, and so forth.

A "recombinant polynucleotide" is a polynucleotide that is not in its native state, e.g., the polynucleotide comprises a nucleotide sequence not found in nature, or the polynucleotide is in a context other than that in which it is naturally found, e.g., separated from nucleotide sequences with which it typically is in proximity in nature, or adjacent (or contiguous with) nucleotide sequences with which it typically is not in proximity. For example, the sequence at issue can be cloned into a vector, or otherwise recombined with one or more additional nucleic acid.

A "polypeptide" is an amino acid sequence comprising a plurality of consecutive polymerized amino acid residues e.g., at least about 15 consecutive polymerized amino acid residues. In many instances, a polypeptide comprises a polymerized amino acid residue sequence that is a regulatory polypeptide or a domain or portion or fragment thereof. Additionally, the polypeptide may comprise: (i) a localization domain; (ii) an activation domain; (iii) a repression domain; (iv) an oligomerization domain; (v) a protein-protein interaction domain; (vi) a DNA-binding domain; or the like. The polypeptide optionally comprises modified amino acid residues, naturally occurring amino acid residues not encoded by a codon, or non-naturally occurring amino acid residues.

"Protein" refers to an amino acid sequence, oligopeptide, peptide, polypeptide or portions thereof whether naturally occurring or synthetic.

In the instant description, "exogenous" refers to a heterologous nucleic acid or polypeptide that may not be naturally expressed in a plant of interest. Exogenous nucleic acids may be introduced into a plant in a stable or transient manner via, for example, transformation or breeding, and may thus serve to produce in planta a homologous RNA molecule and an encoded and functional polypeptide. Exogenous nucleic acids and polypeptides introduced thusly may comprise sequences that are wholly or partially identical or homologous to sequences that naturally occur in (i.e., are endogenous with respect to) the plant.

A "recombinant polypeptide" is a polypeptide produced by translation of a recombinant polynucleotide. A "synthetic polypeptide" is a polypeptide created by consecutive polymerization of isolated amino acid residues using methods well known in the art. An "isolated polypeptide," whether a naturally occurring or a recombinant polypeptide, is more enriched in (or out of) a cell than the polypeptide in its natural state in a wild-type cell, e.g., more than about 5% enriched, more than about 10% enriched, or more than about 20%, or more than about 50%, or more, enriched, i.e., alternatively denoted: 105%, 110%, 120%, 150% or more, enriched relative to wild type standardized at 100%. Such an enrichment is not the result of a natural response of a wild-type plant. Alternatively, or additionally, the isolated polypeptide is separated from other cellular components with which it is typically associated, e.g., by any of the various protein purification methods herein.

"Identity" or "similarity" refers to sequence similarity between two polynucleotide sequences or between two polypeptide sequences, with identity being a more strict comparison. The phrases "percent identity" and "% identity" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar or identical, or any integer value between 0-100%. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polyBLAST nucleotide sequences is a function of the number of identical, matching or corresponding nucleotides at positions shared by the polynucleotide sequences. A degree of identity of polypeptide sequences is a function of the number of identical amino acids at corresponding positions shared by the polypeptide sequences. A degree of homology or similarity of polypeptide sequences is a function of the number of amino acids at corresponding positions shared by the polypeptide sequences. The fraction or percentage of components in common is related to the homology or identity between the sequences. Alignments such as those of FIG. 2A-2E may be used to identify conserved domains and relatedness within these domains. An alignment may suitably be determined by means of computer programs known in the art, such as MACVECTOR software, (1999; Accelrys, Inc., San Diego, Calif.).

"Homologous sequences" refers to polynucleotide or polypeptide sequences that are similar due to common ancestry and sequence conservation. The terms "ortholog" and "paralog" are defined below in the section entitled "Orthologs and Paralogs". In brief, orthologs and paralogs are evolutionarily related genes that have similar sequences and functions. Orthologs are structurally related genes in different species that are derived by a speciation event. Paralogs are structurally related genes within a single species that are derived by a duplication event.

"Functional homologs" are polynucleotide or polypeptide sequences, including orthologs and paralogs, that are similar due to common ancestry and sequence conservation and have identical or similar function at the catalytic, cellular, or organismal levels. The presently disclosed polypeptides, clade members and phylogenetically related sequences are "functionally-related and/or closely-related" by having descended from common ancestral sequences, and/or by being sufficiently similar to the sequences and domains listed in the instant Tables and Sequence Listing that they confer the same function to plants of increased photosynthetic resource use efficiency, increased yield, increased grain yield, increased light use efficiency, increased photosynthetic capacity, increased photosynthetic rate, greater vigor, and/or greater biomass as compared to a control plant.

Functionally-related and/or closely-related polypeptides may be created artificially, semi-synthetically, or may occur naturally by having descended from the same ancestral sequence as the disclosed closely-related sequences, where the polypeptides have the function of conferring increased photosynthetic resource use efficiency to plants.

"Conserved domains" are recurring units in molecular evolution, the extents of which can be determined by sequence and structure analysis. A "conserved domain" or "conserved region" as used herein refers to a region in heterologous polynucleotide or polypeptide sequences where there is a relatively high degree of sequence identity between the distinct sequences. Conserved domains contain conserved sequence patterns or motifs that allow for their detection in, and identification and characterization of, polypeptide sequences. A Myb domain is an example of a conserved domain.

A transgenic plant is expected to have improved or increased photosynthetic resource use efficiency relative to a control plant when the transgenic plant is transformed with a recombinant polynucleotide encoding any of the listed polypeptide sequences or polypeptide found in polypeptide clade of any of the listed polypeptide sequences, or when the transgenic plant contains or expresses a listed polypeptide or a member of any of the same polypeptide clades sequence in which the listed polypeptides may be found.

The terms "highly stringent" or "highly stringent condition" refer to conditions that permit hybridization of DNA strands whose sequences are highly complementary, wherein these same conditions exclude hybridization of significantly mismatched DNAs. Polynucleotide sequences capable of hybridizing under stringent conditions with the polynucleotides of the present description may be, for example, variants of the disclosed polynucleotide sequences, including allelic or splice variants, or sequences that encode orthologs or paralogs of presently disclosed polypeptides. Nucleic acid hybridization methods are disclosed in detail by Kashima et al., 1985. *Nature* 313: 402-404; Sambrook et al., 1989. *Molecular Cloning: A Laboratory Manual,* 2nd Ed., *Cold Spring Harbor Laboratory, Cold* Spring Harbor, N.Y., and by Haymes et al., 1985. *Nucleic Acid Hybridization: A Practical Approach*, IRL Press, Washington, D.C., which references are incorporated herein by reference.

In general, stringency is determined by the temperature, ionic strength, and concentration of denaturing agents (e.g., formamide) used in a hybridization and washing procedure (for a more detailed description of establishing and determining stringency, see the section "Identifying Polynucleotides or Nucleic Acids by Hybridization", below). The degree to which two nucleic acids hybridize under various conditions of stringency is correlated with the extent of their similarity. Thus, similar nucleic acid sequences from a variety of sources, such as within a plant's genome (as in the case of paralogs) or from another plant (as in the case of orthologs) that may perform similar functions can be isolated on the basis of their ability to hybridize with known related polynucleotide sequences. Numerous variations are possible in the conditions and means by which nucleic acid hybridization can be performed to isolate related polynucleotide sequences having similarity to sequences known in the art and are not limited to those explicitly disclosed herein. Such an approach may be used to isolate polynucleotide sequences having various degrees of similarity with disclosed polynucleotide sequences, such as, for example, encoded regulatory polypeptides listed in the Sequence Listing, or polypeptides that are phylogenetically related to the polypeptides listed in the Sequence Listing.

"Fragment", with respect to a polynucleotide, refers to a clone or any part of a polynucleotide molecule that retains a usable, functional characteristic. Useful fragments include oligonucleotides and polynucleotides that may be used in hybridization or amplification technologies or in the regulation of replication, transcription or translation. A "polynucleotide fragment" refers to any subsequence of a polynucleotide, typically, of at least about nine consecutive nucleotides, preferably at least about 30 nucleotides, more preferably at least about 50 nucleotides, of any of the sequences provided herein. Exemplary polynucleotide fragments are the first sixty consecutive nucleotides of the polynucleotides listed in the Sequence Listing. Exemplary fragments also include fragments that comprise a region that encodes an conserved domain of a polypeptide. Exemplary fragments also include fragments that comprise a conserved domain of a polypeptide. Exemplary fragments include fragments that comprise an conserved domain of a polypeptide, for example, any of the domains listed in in the instant Tables or in the Sequence Listing.

Fragments may also include subsequences of polypeptides and protein molecules, or a subsequence of the polypeptide. Fragments may have uses in that they may have antigenic potential. In some cases, the fragment or domain is a subsequence of the polypeptide which performs at least one biological function of the intact polypeptide in substantially the same manner, or to a similar extent, as does the intact polypeptide. For example, a polypeptide fragment can comprise a recognizable structural motif or functional domain such as a DNA-binding site or domain that binds to a DNA promoter region, an activation domain, or a domain for protein-protein interactions, and may initiate transcription. Fragments can vary in size from as few as three amino acid residues to the full length of the intact polypeptide, but are preferably at least about 30 amino acid residues in length and more preferably at least about 60 amino acid residues in length.

Fragments may also refer to a functional fragment of a promoter region. For example, a recombinant polynucleotide capable of modulating transcription in a plant may comprise a nucleic acid sequence with similarity to, or a percentage identity to, a promoter region exemplified by a promoter sequence provided in the Sequence Listing (also see promoters listed in Example II), a fragment thereof, or a complement thereof, wherein the nucleic acid sequence, or the fragment thereof, or the complement thereof, regulates expression of a polypeptide in a plant cell.

The term "plant" includes whole plants, shoot vegetative organs/structures (for example, leaves, stems and tubers), roots, flowers and floral organs/structures (for example, bracts, sepals, petals, stamens, carpels, anthers and ovules), seed (including embryo, endosperm, and seed coat) and fruit (the mature ovary), plant tissue (for example, vascular tissue, ground tissue, and the like), pulped, pureed, ground-up, macerated or broken-up tissue, and cells (for example, guard cells, egg cells, and the like), and progeny of same. The class of the plants that can be transformed using the methods provided of the instant description is generally as broad as the class of higher and lower plants amenable to transformation techniques, including angiosperms (monocotyledonous and dicotyledonous plants), gymnosperms, ferns, horsetails, psilophytes, lycophytes, and bryophytes. These plant parts, organs, structures, cells, tissue, or progeny may contain a recombinant polynucleotide of interest, such as one that comprises a described or listed polynucleotide or one that encodes a described or listed polypeptide or a polypeptide that is phylogenetically-related to a listed polypeptide, and is thus a member of the same polypeptide clade.

A "control plant" as used in the present description refers to a plant cell, seed, plant component, plant tissue, plant organ or whole plant used to compare against transgenic or genetically modified plant for the purpose of identifying an enhanced phenotype in the transgenic or genetically modified plant. A control plant may in some cases be a transgenic plant line that comprises an empty vector or marker gene, but does not contain the recombinant polynucleotide of the present description that is expressed in the transgenic or genetically modified plant being evaluated. In general, a control plant is a plant of the same line or variety as the transgenic or genetically modified plant being tested. A suitable control plant would include a genetically unaltered or non-transgenic plant of the parental line used to generate a transgenic plant herein.

A "transgenic plant" refers to a plant that contains genetic material not found in a wild-type plant of the same species, variety or cultivar. The genetic material may include a transgene, an insertional mutagenesis event (such as by transposon or T-DNA insertional mutagenesis), an activation tagging sequence, a mutated sequence, a homologous recombination event or a sequence modified by chimeraplasty. Typically, the foreign genetic material has been introduced into the plant by human manipulation, but any method can be used as one of skill in the art recognizes.

A transgenic line or transgenic plant line refers to the progeny plant or plants deriving from the stable integration of heterologous genetic material into a specific location or locations within the genome of the original transformed cell.

A transgenic plant may contain an expression vector or cassette. The expression vector or cassette typically comprises a polypeptide-encoding sequence operably linked (i.e., under regulatory control of) to appropriate inducible, tissue-enhanced, tissue-specific, or constitutive regulatory sequences that allow for the controlled expression of the polypeptide. The expression vector or cassette can be introduced into a plant by transformation or by breeding after transformation of a parent plant. A plant refers to a whole plant as well as to a plant part, such as seed, fruit, leaf, or root, plant tissue, plant cells or any other plant material, e.g., a plant explant, as well as to progeny thereof, and to in vitro systems that mimic biochemical or cellular components or processes in a cell. In some other embodiments, the expression vectors or cassettes do not occur naturally. In some embodiments, the expression vectors or cassettes comprise a promoter of the present application, and a gene of interest, wherein the promoter and the gene of interest do not link to each other under natural conditions, e.g., the linkage between the promoter and the gene of interest does not exist in nature. For example, in some embodiments, the promoter and the gene of interest are derived from a same plant species, but are not linked to each other under natural conditions. In some embodiments, the promoter and the gene of interest are derived from two different species, e.g., the promoter and the gene of interest are heterologous to each other. In some embodiments, the gene of interest is derived from a different plant species, a bacteria species, a fungal species, a viral species, an algae species, or an animal species. In some embodiments, the expression vectors or cassettes comprise synthetic sequences.

"Germplasm" refers to a genetic material or a collection of genetic resources for an organism from an individual plant, a group of related individual plants (for example, a plant line, a plant variety or a plant family), or a clone derived from a plant line, plant variety, plant species, or plant culture.

A constitutive promoter is active under most environmental conditions, and in most plant parts. Regulation of protein expression in a constitutive manner refers to the control of expression of a gene and/or its encoded protein in all tissues regardless of the surrounding environment or development stage of the plant.

Alternatively, expression of the disclosed or listed polypeptides may be under the regulatory control of a promoter that is not a constitutive promoter. For example, tissue-enhanced (also referred to as tissue-preferred), tissue-specific, cell type-specific, and inducible promoters constitute non-constitutive promoters; that is, these promoters do not regulate protein expression in a constitutive manner. Tissue-enhanced or tissue-preferred promoters facilitate expression of a gene and/or its encoded protein in specific tissue(s) and generally, although perhaps not completely, do not express the gene and/or protein in all other tissues of the plant, or do so to a much lesser extent. Promoters under developmental control include promoters that preferentially initiate transcription in certain tissues, such as xylem, leaves, roots, or seeds. Such promoters are examples of tissue-enhanced or tissue-preferred promoters (see U.S. Pat. No. 7,365,186). Tissue-specific promoters generally confine transgene expression to a single plant part, tissue or cell-type, although many such promoters are not perfectly restricted in their expression and their regulatory control is more properly described as being "tissue-enhanced" or "tissue-preferred". Tissue-enhanced promoters primarily regulate transgene expression in a limited number of plant parts, tissues or cell-types and cause the expression of proteins to be overwhelming restricted to a few particular tissues, plant parts, or cell types. An example of a tissue-enhanced promoter is a "photosynthetic tissue-enhanced promoter", for which the promoter preferentially regulates gene or protein expression in photosynthetic tissues (e.g., leaves, cotyledons, stems, etc.). Tissue-enhanced promoters can be found upstream and operatively linked to DNA sequences normally transcribed in higher levels in certain plant tissues or specifically in certain plant tissues, respectively. "Cell-enhanced", "tissue-enhanced", or "tissue-specific" regulation thus refer to the control of gene or protein expression, for example, by a promoter that drives expression that is not necessarily totally restricted to a single type of cell or tissue, but where expression is elevated in particular cells or tissues to a greater extent than in other cells or tissues within the organism, and in the case of tissue-specific regulation, in a manner that is primarily elevated in a specific tissue. Tissue-enhanced or preferred promoters have been described in, for example, U.S. Pat. No. 7,365,186, or U.S. Pat. No. 7,619,133.

Another example of a promoter that is not a constitutive promoter is a "condition-enhanced" promoter, the latter term referring to a promoter that activates a gene in response to a particular environmental stimulus. This may include, for example, an abiotic stress, infection caused by a pathogen, light treatment, etc., and a condition-enhanced promoter drives expression in a unique pattern which may include expression in specific cell and/or tissue types within the organism (as opposed to a constitutive expression pattern in all cell types of an organism at all times).

"Wild type" or "wild-type", as used herein, refers to a plant cell, seed, plant component, plant tissue, plant organ or whole plant that has not been genetically modified or treated in an experimental sense. Wild-type cells, seed, components, tissue, organs or whole plants may be used as controls to compare levels of expression and the extent and nature of trait modification with cells, tissue or plants of the same species in which a polypeptide's expression is altered, e.g., in that it has been knocked out, overexpressed, or ectopically expressed.

When two or more plants have "similar morphologies", "substantially similar morphologies", "a morphology that is substantially similar", or are "morphologically similar", the plants have comparable forms or appearances, including analogous features such as overall dimensions, height, width, mass, root mass, shape, glossiness, color, stem diameter, leaf size, leaf dimension, leaf density, internode distance, branching, root branching, number and form of inflorescences, and other macroscopic characteristics at a particular stage of growth. It may be difficult to distinguish two plants that are genotypically distinct but morphologically similar based on morphological characteristics alone. If the plants are morphologically similar at all stages of growth, they are also "developmentally similar".

With regard to gene knockouts as used herein, the term "knockout" (KO) refers to a plant or plant cell having a disruption in at least one gene in the plant or cell, where the disruption results in a reduced expression or activity of the polypeptide encoded by that gene compared to a control cell. The knockout can be the result of, for example, genomic disruptions, including transposons, tilling, and homologous recombination, antisense constructs, sense constructs, RNA silencing constructs, or RNA interference. A T-DNA insertion within a gene is an example of a genotypic alteration that may abolish expression of that gene.

"Ectopic expression" or "altered expression" in reference to a polynucleotide indicates that the pattern of expression in, e.g., a transgenic plant or plant tissue, is different from the expression pattern in a wild-type plant or a reference plant of the same species. The pattern of expression may also be compared with a reference expression pattern in a wild-type plant of the same species. For example, the polynucleotide or polypeptide is expressed in a cell or tissue type other than a cell or tissue type in which the sequence is expressed in the wild-type plant, or by expression at a time other than at the time the sequence is expressed in the wild-type plant, or by a response to different inducible agents, such as hormones or environmental signals, or at different expression levels (either higher or lower) compared with those found in a wild-type plant. The term also refers to altered expression patterns that are produced by lowering the levels of expression to below the detection level or completely abolishing expression. The resulting expression pattern can be transient or stable, constitutive or inducible. In reference to a polypeptide, the term "ectopic expression or altered expression" further may relate to altered activity levels resulting from the interactions of the polypeptides with exogenous or endogenous modulators or from interactions with factors or as a result of the chemical modification of the polypeptides.

The term "overexpression" as used herein refers to a greater expression level of a gene in a plant, plant cell or plant tissue, compared to expression of that gene in a wild-type plant, cell or tissue, at any developmental or temporal stage. Overexpression can occur when, for example, the genes encoding one or more polypeptides are under the control of a strong promoter (e.g., the cauliflower mosaic virus 35S transcription initiation region). Overexpression may also be achieved by placing a gene of interest under the control of an inducible or tissue specific promoter, or may be achieved through integration of transposons or engineered T-DNA molecules into regulatory regions of a target gene. Other means for inducing overexpression may include making targeted changes in a gene's native promoter, e.g. through elimination of negative regulatory sequences or engineering positive regulatory sequences, though the use of targeted nuclease activity (such as zinc finger nucleases or TAL effector nucleases) for genome editing. Elimination of micro-RNA binding sites in a gene's transcript may also result in overexpression of that gene. Additionally, a gene may be overexpressed by creating an artificial transcriptional activator targeted to bind specifically to its promoter sequences, comprising an engineered sequence-specific DNA binding domain such as a zinc finger protein or TAL effector protein fused to a transcriptional activation domain. Thus, overexpression may occur throughout a plant, in specific tissues of the plant, or in the presence or absence of particular environmental signals, depending on the promoter or overexpression approach used.

Overexpression may take place in plant cells normally lacking expression of polypeptides functionally equivalent or identical to the present polypeptides. Overexpression may also occur in plant cells where endogenous expression of the present polypeptides or functionally equivalent molecules normally occurs, but such normal expression is at a lower level. Overexpression thus results in a greater than normal production, or "overproduction" of the polypeptide in the plant, cell or tissue.

"Photosynthetic resource-use efficiency" is defined as the rate of photosynthesis achieved per unit use of a given resource. Consequently, increases in photosynthesis relative to the use of a given resource will improve photosynthetic resource-use efficiency. Photosynthesis is constrained by the availability of various resources, including light, water and nitrogen. Improving the efficiency with which photosynthesis makes use of light, water and nitrogen is a means for increasing plant productivity, crop growth, and yield. For the purposes of comparing a plant of interest to a reference or control plant, the ratio of photosynthesis to use of a given resource is often determined for a fixed unit of leaf area. Examples of increased photosynthetic resource-use efficiency would be an increase in the ratio of the rate of photosynthesis for a given leaf relative to, for example, the rate of transpiration from the same leaf area, nitrogen or chlorophyll invested in that leaf area, or light absorbed by that same leaf area. Increased photosynthetic resource use efficiency may result from increased photosynthetic rate, photosynthetic capacity, a decrease in leaf chlorophyll content, a decrease in percentage of nitrogen in leaf dry weight, increased transpiration efficiency, an increase in resistance to water vapor diffusion exerted by leaf stomata, an increased rate of relaxation of photoprotective reactions operating in the light harvesting antennae, a decrease in the ratio of the carbon isotope $^{12}C$ to $^{13}C$ in above-ground biomass, and/or an increase in the total dry weight of above-ground plant material.

"Photosynthetic rate" refers to the rate of photosynthesis achieved by a leaf, and is typically expressed relative to a unit of leaf area. The photosynthetic rate at any given time results from the photosynthetic capacity of the leaf (see below) and the biotic or abiotic environmental constraints prevailing at that time.

"Photosynthetic capacity" refers to the capacity for photosynthesis per unit leaf area and is set by the leafs investment in the components of the photosynthetic apparatus. Key components, among many, would be the pigments and proteins required to regulate light absorption and transduction of light energy to the photosynthetic reaction centers, and the enzymes required to operate the C3 and C4 dark reactions of photosynthesis. Increasing photosynthetic capacity is seen as an important means of increasing leaf and crop-canopy photosynthesis, and crop yield.

"Rubisco (ribulose-1,5-bisphosphate carboxylase oxygenase) activity" refers to the activation state of Rubisco, the most abundant protein in the chloroplast and a key limitation to C3 photosynthesis. Increasing Rubisco activity by: increasing the amount of Rubisco in the chloroplast; impacting any combination of specific reactions that regulate Rubisco activity; or increasing the concentration of $CO_2$ in the chloroplast, is seen as an important means to improving C3 leaf and crop-canopy photosynthesis and crop yield.

The "capacity for RuBP (ribulose-1,5-bisphosphate) regeneration" refers to the rate at which RuBP, a key photosynthetic substrate is regenerated in the Calvin cycle. Increasing the capacity for RuBP regeneration by increasing the activity of enzymes in the regenerative phase of the Calvin cycle is seen as an important means to improving C3 leaf and crop-canopy photosynthesis and crop yield that will become progressively more important as atmospheric $CO_2$ concentrations continue to rise.

"Leaf chlorophyll content" refers to the chlorophyll content of the leaf expressed either per unit leaf area or unit weight. Sun leaves in the upper part of crop canopies are thought to have higher leaf chlorophyll content than is required for photosynthesis. The consequence is that these leaves: invest more nitrogen in chlorophyll than is required for photosynthesis; are prone to photodamage associated with absorbing more light energy than can be dissipated via photosynthesis; and impair the transmission of light into the leaf and lower canopy where photosynthesis is light limited. Consequently, decreasing leaf chlorophyll content of upper canopy leaves is considered an effective means to improving photosynthetic resource-use efficiency.

"Non-photochemical quenching" is a term that covers photoprotective processes that dissipate absorbed light energy as heat from the light-harvesting antenna of photosystem II. Non-photochemical quenching is a key regulator of the efficiency with which electron transport is initiated by PSII and the efficiency of photosynthesis at low light. Decreasing the level of non-photochemical quenching, or increasing the speed with which it relaxes is expected to confer cumulative gains in photosynthesis every time the light intensity to which the canopy is exposed transitions from high to low, and is considered a means to improving canopy photosynthesis when integrated over a growing season.

"Nitrogen limitation" or "nitrogen-limiting" refers to nitrogen levels that act as net limitations on primary production in terrestrial or aquatic biomes. Much of terrestrial growth, including much of crop growth, is limited by the availability of nitrogen, which can be alleviated by nitrogen input through deposition or fertilization.

"Water use efficiency", or WUE, measured as the biomass produced per unit transpiration, describes the relationship between water use and crop production. The basic physiological definition of WUE equates to the ratio of photosynthesis (A) to transpiration (T), also referred to as transpiration efficiency (Karaba et al. 2007, supra; Morison et al., 2008, supra).

"Stomatal conductance" refers to a measurement of the limitation that the stomatal pore imposes on $CO_2$ diffusion into, and $H_2O$ diffusion out of, the leaf. Decreasing stomatal conductance will decrease water loss from the leaf and crop canopy via transpiration. This will conserve soil water, delay the onset and reduce the severity of drought effects on canopy photosynthesis and other physiology. Decreasing stomatal conductance will also decrease photosynthesis. However, the magnitude of the decrease in photosynthesis will typically be less than the decrease in transpiration, and transpiration efficiency will increase as a result. Conversely, increasing stomatal conductance can increase the diffusion of $CO_2$ into the leaf and increase photosynthesis in a C3 leaf. Typically, transpiration will increase to a greater extent than photosynthesis, and transpiration efficiency will therefore decrease.

"Yield" or "plant yield" refers to increased plant growth, increased crop growth, increased biomass, and/or increased plant product production (including grain), and is dependent to some extent on temperature, plant size, organ size, planting density, light, water and nutrient availability, and how the plant copes with various stresses, such as through temperature acclimation and water or nutrient use efficiency. For grain crops, yield generally refers to an amount of grain produced or harvested per unit of land area, such as bushels or tons per acre or tonnes per hectare. Increased or improved yield may be measured as increased seed yield, increased plant product yield (plant products include, for example, plant tissue, including ground or otherwise broken-up plant tissue, and products derived from one or more types of plant tissue), or increased vegetative yield.

Description of the Specific Embodiments

Regulatory Polypeptides Modify Expression of Endogenous Genes

A regulatory polypeptide may include, but is not limited to, any polypeptide that can activate or repress transcription of a single gene or a number of genes. As one of ordinary skill in the art recognizes, regulatory polypeptides can be identified by the presence of a region or domain of structural similarity or identity to a specific consensus sequence or the presence of a specific consensus DNA-binding motif (see, for example, Riechmann et al., 2000a. supra).

Generally, regulatory polypeptides control the manner in which information encoded by genes is used to produce gene products and control various pathways, and may be involved in diverse processes including, but not limited to, cell differentiation, proliferation, morphogenesis, and the regulation of growth or environmental responses. Accordingly, one skilled in the art would recognize that by expressing the present sequences in a plant, one may change the expression of autologous genes or induce the expression of introduced genes. By affecting the expression of similar autologous sequences in a plant that have the biological activity of the present sequences, or by introducing the present sequences into a plant, one may alter a plant's phenotype to one with improved traits related to photosynthetic resource use efficiency. The sequences of the instant description may also be used to transform a plant and introduce desirable traits not found in the wild-type cultivar or strain. Plants may then be selected for those that produce the most desirable degree of over- or under-expression of target genes of interest and coincident trait improvement.

The sequences of the present description may be from any species, particularly plant species, in a naturally occurring form or from any source whether natural, synthetic, semi-synthetic or recombinant. The sequences of the instant description may also include fragments of the present amino acid sequences. Where "amino acid sequence" is recited to refer to an amino acid sequence of a naturally occurring protein molecule, "amino acid sequence" and like terms are not meant to limit the amino acid sequence to the complete native amino acid sequence associated with the recited protein molecule.

In addition to methods for modifying a plant phenotype by employing one or more polynucleotides and polypeptides of the instant description described herein, the polynucleotides and polypeptides of the instant description have a variety of additional uses. These uses include their use in the recombinant production (i.e., expression) of proteins; as regulators of plant gene expression, as diagnostic probes for the presence of complementary or partially complementary nucleic acids (including for detection of natural coding nucleic acids); as substrates for further reactions, e.g., mutation reactions, PCR reactions, or the like; as substrates for cloning e.g., including digestion or ligation reactions; and for identifying exogenous or endogenous modulators of the regulatory polypeptides. The polynucleotide can be, e.g., genomic DNA or RNA, a transcript (such as an mRNA), a cDNA, a PCR product, a cloned DNA, a synthetic DNA or RNA, or the like. The polynucleotide can comprise a sequence in either sense or antisense orientations.

Expression of genes that encode polypeptides that modify expression of endogenous genes, polynucleotides, and proteins are well known in the art. In addition, transgenic plants comprising polynucleotides encoding regulatory polypeptides may also modify expression of endogenous genes, polynucleotides, and proteins. Examples include Peng et al., 1997. *Genes Development* 11: 3194-3205, and Peng et al., 1999. *Nature* 400: 256-261. In addition, many others have demonstrated that an *Arabidopsis* regulatory polypeptide expressed in an exogenous plant species elicits the same or very similar phenotypic response. See, for example, Fu et al., 2001. *Plant Cell* 13: 1791-1802; Nandi et al., 2000. *Curr. Biol.* 10: 215-218; Coupland, 1995. *Nature* 377: 482-483; and Weigel and Nilsson, 1995. *Nature* 377: 482-500.

In another example, Mandel et al., 1992b. *Cell* 71-133-143, and Suzuki et al., 2001. *Plant J.* 28: 409-418, teach that a transcription factor expressed in another plant species elicits the same or very similar phenotypic response of the endogenous sequence, as often predicted in earlier studies of *Arabidopsis* transcription factors in *Arabidopsis* (see Mandel et al., 1992a. *Nature* 360: 273-277; Suzuki et al., 2001. supra). Other examples include Müller et al., 2001. *Plant J.* 28: 169-179; Kim et al., 2001. *Plant J.* 25: 247-259; Kyozuka and Shimamoto, 2002. *Plant Cell Physiol.* 43: 130-135; Boss and Thomas, 2002. *Nature,* 416: 847-850; He et al., 2000. *Transgenic Res.* 9: 223-227; and Robson et al., 2001. *Plant J.* 28: 619-631.

In yet another example, Gilmour et al., 1998. *Plant J.* 16: 433-442 teach an *Arabidopsis* AP2 transcription factor, CBF1, which, when overexpressed in transgenic plants, increases plant freezing tolerance. Jaglo et al., 2001. *Plant Physiol.* 127: 910-917, further identified sequences in *Brassica napus* which encode CBF-like genes and that transcripts for these genes accumulated rapidly in response to low temperature. Transcripts encoding CBF proteins were also found to accumulate rapidly in response to low temperature in wheat, as well as in tomato. An alignment of the CBF proteins from *Arabidopsis, B. napus*, wheat, rye, and tomato revealed the presence of conserved consecutive amino acid residues which bracket the AP2/EREBP DNA binding domains of the proteins and distinguish them from other members of the AP2/EREBP protein family (Jaglo et al., 2001. supra).

Regulatory polypeptides mediate cellular responses and control traits through altered expression of genes containing cis-acting nucleotide sequences that are targets of the introduced regulatory polypeptide. It is well appreciated in the art that the effect of a regulatory polypeptide on cellular responses or a cellular trait is determined by the particular genes whose expression is either directly or indirectly (e.g., by a cascade of regulatory polypeptide binding events and transcriptional changes) altered by regulatory polypeptide binding. In a global analysis of transcription comparing a standard condition with one in which a regulatory polypeptide is overexpressed, the resulting transcript profile associated with regulatory polypeptide overexpression is related to the trait or cellular process controlled by that regulatory polypeptide. For example, the PAP2 gene and other genes in the Myb family have been shown to control anthocyanin biosynthesis through regulation of the expression of genes known to be involved in the anthocyanin biosynthetic pathway (Bruce et al., 2000. *Plant Cell* 12: 65-79; and Borevitz et al., 2000. *Plant Cell* 12: 2383-2393). Further, global transcript profiles have been used successfully as diagnostic tools for specific cellular states (e.g., cancerous vs. non-cancerous; Bhattacharjee et al., 2001. *Proc. Natl. Acad. Sci. USA* 98: 13790-13795; and Xu et al., 2001. *Proc. Natl. Acad. Sci. USA* 98: 15089-15094). Consequently, it is evident to one skilled in the art that similarity of transcript profile upon overexpression of different regulatory polypeptides would indicate similarity of regulatory polypeptide function.

Polypeptides and Polynucleotides of the Present Description.

The present description includes putative regulatory polypeptides, and isolated or recombinant polynucleotides encoding the polypeptides, or novel sequence variant polypeptides or polynucleotides encoding novel variants of polypeptides derived from the specific sequences provided in the Sequence Listing; the recombinant polynucleotides of the instant description may be incorporated in expression vectors for the purpose of producing transformed plants.

Because of their relatedness at the nucleotide level, the claimed sequences will typically share at least about 30% nucleotide sequence identity, or at least 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% sequence identity to one or more of the listed full-length sequences, or to a listed sequence but excluding or outside of the region(s) encoding a known consensus sequence or consensus DNA-binding site, or outside of the region(s) encoding one or all conserved domains. The degeneracy of the genetic code enables major variations in the nucleotide sequence of a polynucleotide while maintaining the amino acid sequence of the encoded protein.

Because of their relatedness at the protein level, the claimed nucleotide sequences will typically encode a polypeptide that is at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical in its amino acid sequence to the entire length of any of the polypeptides listed in the Sequence Listing or the instant Tables, or closely- or phylogenetically-related sequences.

Also provided are methods for modifying yield from a plant by modifying the mass, size or number of plant organs or seed of a plant by controlling a number of cellular processes, and for increasing a plant's photosynthetic resource use efficiency. These methods are based on the ability to alter the expression of critical regulatory molecules that may be conserved between diverse plant species. Related conserved regulatory molecules may be originally discovered in a model system such as *Arabidopsis* and homologous, functional molecules then discovered in other plant species. The latter may then be used to confer increased yield or photosynthetic resource use efficiency in diverse plant species.

Sequences in the Sequence Listing, derived from diverse plant species, may be ectopically expressed in overexpressor plants. The changes in the characteristic(s) or trait(s) of the plants may then be observed and found to confer increased yield and/or increased photosynthetic resource use efficiency. Therefore, the polynucleotides and polypeptides can be used to improve desirable characteristics of plants.

The polynucleotides of the instant description are also ectopically expressed in overexpressor plant cells and the changes in the expression levels of a number of genes, polynucleotides, and/or proteins of the plant cells observed. Therefore, the polynucleotides and polypeptides can be used to change expression levels of genes, polynucleotides, and/or proteins of plants or plant cells.

The data presented herein represent the results obtained in experiments with polynucleotides and polypeptides that may be expressed in plants for the purpose of increasing yield that arises from improved photosynthetic resource use efficiency.

Variants of the Disclosed Sequences.

Also within the scope of the instant description is a variant of a nucleic acid listed in the Sequence Listing, that is, one having a sequence that differs from the one of the polynucleotide sequences in the Sequence Listing, or a complementary sequence, that encodes a functionally equivalent polypeptide (i.e., a polypeptide having some degree of equivalent or similar biological activity) but differs in sequence from the sequence in the Sequence Listing, due to degeneracy in the genetic code. Included within this definition are polymorphisms that may or may not be readily detectable using a particular oligonucleotide probe of the polynucleotide encoding polypeptide, and improper or unexpected hybridization to allelic variants, with a locus other than the normal chromosomal locus for the polynucleotide sequence encoding polypeptide.

Differences between presently disclosed polypeptides and polypeptide variants are limited so that the sequences of the former and the latter are closely similar overall and, in many regions, identical. Presently disclosed polypeptide sequences and similar polypeptide variants may differ in amino acid sequence by one or more substitutions, additions, deletions, fusions and truncations, which may be present in any combination. These differences may produce silent changes and result in a functionally equivalent polypeptides. Thus, it will be readily appreciated by those of skill in the art, that any of a variety of polynucleotide sequences is capable of encoding the polypeptides and homolog polypeptides of the instant description. A polypeptide sequence variant may have "conservative" changes, wherein a substituted amino acid has similar structural or chemical properties.

Conservative substitutions include substitutions in which at least one residue in the amino acid sequence has been removed and a different residue inserted in its place. Such substitutions generally are made in accordance with the Table 1 when it is desired to maintain the activity of the protein. Table 1 shows amino acids which can be substituted for an amino acid in a protein and which are typically regarded as conservative substitutions.

TABLE 1

Possible conservative amino acid substitutions

| Amino Acid Residue | Conservative substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Pro | Gly |
| Ser | Thr; Gly |
| Thr | Ser; Val |
| Trp | Tyr |
| Tyr | Trp; Phe |
| Val | Ile; Leu |

The polypeptides provided in the Sequence Listing have a novel activity, such as, for example, regulatory activity. Although all conservative amino acid substitutions (for example, one basic amino acid substituted for another basic amino acid) in a polypeptide will not necessarily result in the polypeptide retaining its activity, it is expected that many of these conservative mutations would result in the polypeptide retaining its activity. Most mutations, conservative or non-conservative, made to a protein but outside of a conserved domain required for function and protein activity will not affect the activity of the protein to any great extent.

Deliberate amino acid substitutions may thus be made on the basis of similarity in polarity, charge, solubility, hydrophobicity, hydrophilicity, and/or the amphipathic nature of the residues, as long as a significant amount of the functional or biological activity of the polypeptide is retained. For example, negatively charged amino acids may include aspartic acid and glutamic acid, positively charged amino acids may include lysine and arginine, and amino acids with uncharged polar head groups having similar hydrophilicity values may include leucine, isoleucine, and valine; glycine and alanine; asparagine and glutamine; serine and threonine; and phenylalanine and tyrosine. More rarely, a variant may have "non-conservative" changes, e.g., replacement of a glycine with a tryptophan Similar minor variations may also include amino acid deletions or insertions, or both. Related polypeptides may comprise, for example, additions and/or deletions of one or more N-linked or O-linked glycosylation sites, or an addition and/or a deletion of one or more cysteine residues. Guidance in determining which and how many amino acid residues may be substituted, inserted or deleted without abolishing functional or biological activity may be found using computer programs well known in the art, for example, DNASTAR software (see U.S. Pat. No. 5,840,544).

Conserved Domains.

Conserved domains are recurring functional and/or structural units of a protein sequence within a protein family (for example, a family of regulatory proteins), and distinct conserved domains have been used as building blocks in molecular evolution and recombined in various arrangements to make proteins of different protein families with different functions. Conserved domains often correspond to the 3-dimensional domains of proteins and contain conserved sequence patterns or motifs, which allow for their detection in polypeptide sequences with, for example, the use of a Conserved Domain Database (for example, at www.ncbi.nlm.nih.gov/cdd). The National Center for Biotechnology Information Conserved Domain Database defines conserved domains as recurring units in molecular evolution, the extents of which can be determined by sequence and structure analysis. Conserved domains contain conserved sequence patterns or motifs, which allow for their detection in polypeptide sequences (Conserved Domain Database; www.ncbi.nlm.nih.gov/Structure/cdd/cdd.shtml).

Conserved domains may also be identified as regions or domains of identity to a specific consensus sequence (see, for example, Riechmann et al., 2000a. Science 290, 2105-2110; Riechmann et al., 2000b. Curr Opin Plant Biol 3: 423-434). Thus, by using alignment methods well known in the art, the conserved domains of the plant polypeptides, for example, for the Myb domain polypeptides may be determined. The polypeptides of the instant Tables have conserved domains associated with the disclosed functions of the proteins in which they are found and specifically indicated by amino acid coordinate start and stop sites. A comparison of the regions of these polypeptides allows one of skill in the art (see, for example, Reeves and Nissen, 1990. J. Biol. Chem. 265, 8573-8582; Reeves and Nissen, 1995. Prog. Cell Cycle Res. 1: 339-349) to identify domains or conserved domains for any of the polypeptides listed or referred to in this disclosure.

Conserved domain models are generally identified with multiple sequence alignments of related proteins spanning a variety of organisms (for example, conserved domains of the disclosed sequences can be found in the instant Figures, Tables, and the Sequence Listing). These alignments reveal sequence regions containing the same, or similar, patterns of amino acids. Multiple sequence alignments, three-dimensional structure and three-dimensional structure superposition of conserved domains can be used to infer sequence, structure, and functional relationships (Conserved Domain Database, supra). Since the presence of a particular conserved domain within a polypeptide (prophetically including any of the instantly listed polypeptides) is highly correlated with an evolutionarily conserved function, a conserved domain database may be used to identify the amino acids in a protein sequence that are putatively involved in functions such as binding or catalysis, as mapped from conserved domain annotations to the query sequence. For example, the presence in a protein of Myb domain that is structurally and phylogenetically similar to one or more domains shown in the instant Tables would be a strong indicator of a related function in plants (e.g., the function of regulating and/or improving yield, light use efficiency, photosynthetic capacity, photosynthetic rate, photosynthetic resource use efficiency, vigor, and/or biomass as compared to a control plant; i.e., a polypeptide with such a domain is expected to confer altered yield, light use efficiency, photosynthetic capacity, photosynthetic rate, photosynthetic resource use efficiency, vigor, and/or biomass as compared to a control plant when its expression level is altered). Sequences herein referred to as functionally-related and/or closely-related to the sequences or domains listed in the instant Tables, including polypeptides that are closely related to the polypeptides of the instant description, may have conserved domains that share at least at least nine base pairs (bp) in length and at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% amino acid identity to the sequences provided in the Sequence Listing or in the instant Tables, and have similar functions in that the polypeptides of the instant description. Said polypeptides may, when their expression level is altered by suppressing their expression, knocking out their expression, or increasing their expression, confer at least one regulatory activity selected from the group consisting of increased yield, increased light use efficiency, increased photosynthetic capacity, increased photosynthetic rate, increased photosynthetic resource use efficiency, greater vigor, and/or greater biomass as compared to a control plant.

Methods using manual alignment of sequences similar or homologous to one or more polynucleotide sequences or one or more polypeptides encoded by the polynucleotide sequences may be used to identify regions of similarity and conserved domains or other motifs. Such manual methods are well-known of those of skill in the art and can include, for example, comparisons of tertiary structure between a polypeptide sequence encoded by a polynucleotide that comprises a known function and a polypeptide sequence encoded by a polynucleotide sequence that has a function not yet determined. Such examples of tertiary structure may comprise predicted alpha helices, beta-sheets, amphipathic helices, leucine zipper motifs, zinc finger motifs, proline-rich regions, cysteine repeat motifs, and the like.

With respect to polynucleotides encoding presently disclosed polypeptides, a conserved domain refers to a subsequence within a polypeptide family (for example, in any of the instantly listed polypeptides or members of the listed polypeptide families) the presence of which is correlated with at least one function exhibited by members of the polypeptide family, and which exhibits a high degree of sequence homology, such as at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to a conserved domain of a polypeptide of the Sequence Listing or listed in the instant Tables that show the instant polypeptides and closely-related or phylogenetically-related sequences. Sequences that possess or encode for conserved domains that meet these criteria of percentage identity, and that have comparable biological and regulatory activity to the present polypeptide sequences, thus being members of the clade polypeptides or sequences listed in the sequence Listing or in Example I, are described. Sequences having lesser degrees of identity but comparable biological activity are considered to be equivalents.

Orthologs and Paralogs.

Homologous sequences as described above can comprise orthologous or paralogous sequences. Several different methods are known by those of skill in the art for identifying and defining these functionally homologous sequences. General methods for identifying orthologs and paralogs, including phylogenetic methods, sequence similarity and hybridization methods, are described herein; an ortholog or paralog, including equivalogs, may be identified by one or more of the methods described below.

As described by Eisen, 1998. *Genome Res.* 8: 163-167, evolutionary information may be used to predict gene function. It is common for groups of genes that are homologous in sequence to have diverse, although usually related, functions. However, in many cases, the identification of homologs is not sufficient to make specific predictions because not all homologs have the same function. Thus, an initial analysis of functional relatedness based on sequence similarity alone may not provide one with a means to determine where similarity ends and functional relatedness begins. Fortunately, it is well known in the art that protein function can be classified using phylogenetic analysis of gene trees combined with the corresponding species. Functional predictions can be greatly improved by focusing on how the genes became similar in sequence (i.e., by evolutionary processes) rather than on the sequence similarity itself (Eisen, supra). In fact, many specific examples exist in which gene function has been shown to correlate well with gene phylogeny (Eisen, supra). Thus, "[t]he first step in making functional predictions is the generation of a phylogenetic tree representing the evolutionary history of the gene of interest and its homologs. Such trees are distinct from clusters and other means of characterizing sequence similarity because they are inferred by techniques that help convert patterns of similarity into evolutionary relationships . . . . After the gene tree is inferred, biologically determined functions of the various homologs are overlaid onto the tree. Finally, the structure of the tree and the relative phylogenetic positions of genes of different functions are used to trace the history of functional changes, which is then used to predict functions of [as yet] uncharacterized genes" (Eisen, supra).

Within a single plant species, gene duplication may cause two copies of a particular gene, giving rise to two or more genes with similar sequence and often similar function known as paralogs. A paralog is therefore a similar gene formed by duplication within the same species. Paralogs typically cluster together or in the same clade (a group of similar genes) when a gene family phylogeny is analyzed using programs such as CLUSTAL (Thompson et al., 1994. *Nucleic Acids Res.* 22: 4673-4680; Higgins et al., 1996. *Methods Enzymol.* 266: 383-402). Groups of similar genes can also be identified with pair-wise BLAST analysis (Feng and Doolittle, 1987. *J. Mol. Evol.* 25: 351-360). For example, a clade of very similar MADS domain transcription factors from *Arabidopsis* all share a common function in flowering time (Ratcliffe et al., 2001. *Plant Physiol.* 126: 122-132), and a group of very similar AP2 domain transcription factors from *Arabidopsis* are involved in tolerance of plants to freezing (Gilmour et al., 1998. supra). Analysis of groups of similar genes with similar function that fall within one clade can yield sub-sequences that are particular to the clade. These sub-sequences, known as consensus sequences, can not only be used to define the sequences within each clade, but define the functions of these genes; genes within a clade may contain paralogous sequences, or orthologous sequences that share the same function (see also, for example, Mount, 2001, in *Bioinformatics: Sequence and Genome Analysis*, Cold Spring Harbor Laboratory Press, Cold Spring Harbor, N.Y., p. 543).

Regulatory polypeptide gene sequences are conserved across diverse eukaryotic species lines (Goodrich et al., 1993. *Cell* 75:519-530; Lin et al., 1991. *Nature* 353:569-571; Sadowski et al., 1988. *Nature* 335: 563-564). Plants are no exception to this observation; diverse plant species possess regulatory polypeptides that have similar sequences and functions. Speciation, the production of new species from a parental species, gives rise to two or more genes with similar sequence and similar function. These genes, termed orthologs, often have an identical function within their host plants and are often interchangeable between species without losing function. Because plants have common ancestors, many genes in any plant species will have a corresponding orthologous gene in another plant species. Once a phylogenic tree for a gene family of one species has been constructed using a program such as CLUSTAL (Thompson et al., 1994. supra; Higgins et al., 1996. supra) potential orthologous sequences can be placed into the phylogenetic tree and their relationship to genes from the species of interest can be determined. Orthologous sequences can also be identified by a reciprocal BLAST strategy. Once an orthologous sequence has been identified, the function of the ortholog can be deduced from the identified function of the reference sequence.

By using a phylogenetic analysis, one skilled in the art would recognize that the ability to deduce similar functions conferred by closely-related polypeptides is predictable. This predictability has been confirmed by our own many studies in which we have found that a wide variety of polypeptides have orthologous or closely-related homologous sequences that function as does the first, closely-related reference sequence. For example, distinct regulatory polypeptides, including:

(i) AP2 family *Arabidopsis* G47 (found in U.S. Pat. No. 7,135,616), a phylogenetically-related sequence from soybean, and two phylogenetically-related homologs from rice all can confer greater tolerance to drought, hyperosmotic stress, or delayed flowering as compared to control plants;

(ii) CAAT family *Arabidopsis* G481 (found in PCT patent publication no. WO2004076638), and numerous phylogenetically-related sequences from eudicots and monocots can confer greater tolerance to drought-related stress as compared to control plants;

(iii) Myb-related *Arabidopsis* G682 (found in U.S. Pat. Nos. 7,223,904 and 7,193,129) and numerous phylogenetically-related sequences from eudicots and monocots can confer greater tolerance to heat, drought-related stress, cold, and salt as compared to control plants;

(iv) WRKY family *Arabidopsis* G1274 (found in U.S. Pat. No. 7,196,245) and numerous closely-related sequences from eudicots and monocots have been shown to confer increased water deprivation tolerance, and (v) AT-hook family soy sequence G3456 (found in U.S. patent publication no. 20040128712A1) and numerous phylogenetically-related sequences from eudicots and monocots, increased biomass compared to control plants when these sequences are overexpressed in plants.

Examples of Methods for Identifying Identity, Similarity, Homology and Relatedness.

Percent identity can be determined electronically, e.g., by using the MEGALIGN program (DNASTAR, Inc. Madison, Wis.). The MEGALIGN program can create alignments between two or more sequences according to different methods, for example, the clustal method (see, for example, Higgins and Sharp, 1988. *Gene* 73: 237-244). The clustal algorithm groups sequences into clusters by examining the distances between all pairs. The clusters are aligned pairwise and then in groups. Other alignment algorithms or programs may be used for preparing alignments and/or determining percentage identities, including Accelrys Gene, FASTA, BLAST, or ENTREZ, FASTA and BLAST, some of which may also be used to calculate percent similarity. Accelrys Gene is available from Accelrys, Inc., San Diego, Calif. Other programs are available as a part of the GCG sequence analysis package (University of Wisconsin, Madison, Wis.), and can be used with or without default settings. ENTREZ is available through the National Center for Biotechnology Information. In one embodiment, the percent identity of two sequences can be determined by the GCG program with a gap weight of 1, e.g., each amino acid gap is weighted as if it were a single amino acid or nucleotide mismatch between the two sequences (see U.S. Pat. No. 6,262,333).

Software for performing BLAST analyses is publicly available, e.g., through the National Center for Biotechnology Information (see internet website at www.ncbi.nlm nih gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul, 1990. *J. Mol. Biol.* 215: 403-410; Altschul, 1993. *J. Mol. Evol.* 36: 290-300). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff and Henikoff, 1989. supra; Henikoff and Henikoff, 1991. supra). Unless otherwise indicated for comparisons of predicted polynucleotides, "sequence identity"

refers to the % sequence identity generated from a tBLASTx using the NCBI version of the algorithm at the default settings using gapped alignments with the filter "off" (see, for example, internet website at www.ncbi.nlm nih gov).

Other techniques for alignment are described by Doolittle, ed., 1996. *Methods in Enzymology*, vol. 266: "Computer Methods for Macromolecular Sequence Analysis" Academic Press, Inc., San Diego, Calif., USA. Preferably, an alignment program that permits gaps in the sequence is utilized to align the sequences. The Smith-Waterman is one type of algorithm that permits gaps in sequence alignments (see Shpaer, 1997. *Methods Mol. Biol.* 70: 173-187). Also, the GAP program using the Needleman and Wunsch alignment method can be utilized to align sequences. An alternative search strategy uses MPSRCH software, which runs on a MASPAR computer. MPSRCH uses a Smith-Waterman algorithm to score sequences on a massively parallel computer. This approach improves ability to pick up distantly related matches, and is especially tolerant of small gaps and nucleotide sequence errors. Nucleic acid-encoded amino acid sequences can be used to search both protein and DNA databases.

The percentage similarity between two polypeptide sequences, e.g., sequence A and sequence B, is calculated by dividing the length of sequence A, minus the number of gap residues in sequence A, minus the number of gap residues in sequence B, into the sum of the residue matches between sequence A and sequence B, times one hundred. Gaps of low or of no similarity between the two amino acid sequences are not included in determining percentage similarity. Percent identity between polynucleotide sequences can also be counted or calculated by other methods known in the art, e.g., the Jotun Hein method (see, for example, Hein, 1990. *Methods Enzymol.* 183: 626-645). Identity between sequences can also be determined by other methods known in the art, e.g., by varying hybridization conditions (see U.S. patent publication no. 20010010913).

The percent identity between two polypeptide sequences can also be determined using *Accelrys Gene* v2.5, 2006 with default parameters: Pairwise Matrix: GONNET; Align Speed: Slow; Open Gap Penalty: 10.000; Extended Gap Penalty: 0.100; Multiple Matrix: GONNET; Multiple Open Gap Penalty: 10.000; Multiple Extended Gap Penalty: 0.05; Delay Divergent: 30; Gap Separation Distance: 8; End Gap Separation: false; Residue Specific Penalties: false; Hydrophilic Penalties: false; Hydrophilic Residues: GPSNDQEKR. The default parameters for determining percent identity between two polynucleotide sequences using Accelrys Gene are: Align Speed: Slow; Open Gap Penalty: 10.000; Extended Gap Penalty: 5.000; Multiple Open Gap Penalty: 10.000; Multiple Extended Gap Penalty: 5.000; Delay Divergent: 40; Transition: Weighted.

In addition, one or more polynucleotide sequences or one or more polypeptides encoded by the polynucleotide sequences may be used to search against a BLOCKS (Bairoch et al., 1997. *Nucleic Acids* Res. 25: 217-221), PFAM, and other databases which contain previously identified and annotated motifs, sequences and gene functions. Methods that search for primary sequence patterns with secondary structure gap penalties (Smith et al., 1992. *Protein Engineering* 5: 35-51) as well as algorithms such as Basic Local Alignment Search Tool (BLAST; Altschul, 1990, supra; Altschul et al., 1993, supra), BLOCKS (Henikoff and Henikoff, 1991, supra), Hidden Markov Models (HMM; Eddy, 1996. *Curr. Opin. Str. Biol.* 6: 361-365; Sonnhammer et al., 1997. *Proteins* 28: 405-420), and the like, can be used to manipulate and analyze polynucleotide and polypeptide sequences encoded by polynucleotides. These databases, algorithms and other methods are well known in the art and are described in Ausubel et al., 1997. *Short Protocols in Molecular Biology*, John Wiley & Sons, New York, N.Y., unit 7.7, and in Meyers, 1995. *Molecular Biology and Biotechnology*, Wiley VCH, New York, N.Y., p 856-853.

Thus, the instant description provides methods for identifying a sequence similar or paralogous or orthologous or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an internet or intranet) and a query is made against the sequence database using the relevant sequences herein and associated plant phenotypes or gene functions.

A further method for identifying or confirming that specific homologous sequences control the same function is by comparison of the transcript profile(s) obtained upon overexpression or knockout of two or more related polypeptides. Since transcript profiles are diagnostic for specific cellular states, one skilled in the art will appreciate that genes that have a highly similar transcript profile (e.g., with greater than 50% regulated transcripts in common, or with greater than 70% regulated transcripts in common, or with greater than 90% regulated transcripts in common) will have highly similar functions. Fowler and Thomashow, 2002. *Plant Cell* 14, 1675-1690, have shown that three paralogous AP2 family genes (CBF1, CBF2 and CBF3) are induced upon cold treatment, each of which can condition improved freezing tolerance, and all have highly similar transcript profiles. Once a polypeptide has been shown to provide a specific function, its transcript profile becomes a diagnostic tool to determine whether paralogs or orthologs have the same function.

Identifying Polynucleotides or Nucleic Acids by Hybridization.

Polynucleotides homologous to the sequences illustrated in the Sequence Listing and tables can be identified, e.g., by hybridization to each other under stringent or under highly stringent conditions. Stringency is influenced by a variety of factors, including temperature, salt concentration and composition, organic and non-organic additives, solvents, etc. present in both the hybridization and wash solutions and incubations, and the number of washes, as described in more detail in the references cited below (e.g., Sambrook et al., 1989. supra; Berger and Kimmel, eds., 1987. *Methods Enzymol.* 152: 507-511; Anderson and Young, 1985. "Quantitative Filter Hybridisation", In: Hames and Higgins, ed., *Nucleic Acid Hybridisation, A Practical Approach*. Oxford, IRL Press, 73-111), each of which are incorporated herein by reference. Conditions that are highly stringent, and means for achieving them, are also well known in the art and described in, for example, Sambrook et al., 1989. supra; Berger and Kimmel, eds., 1987. *Meth. Enzymol.* 152:467-469; and Anderson and Young, 1985. supra.

Also provided in the instant description are polynucleotide sequences that are capable of hybridizing to the claimed polynucleotide sequences, including any of the polynucleotides within the Sequence Listing, and fragments thereof under various conditions of stringency (see, for example, Wahl and Berger, 1987. *Methods Enzymol.* 152: 399-407; Berger and Kimmel, ed., 1987. *Methods Enzymol.* 152:507-511). In addition to the nucleotide sequences listed in the Sequence Listing, full length cDNA, orthologs, and paralogs of the present nucleotide sequences may be identified and isolated using well-known methods. The cDNA libraries, orthologs, and paralogs of the present nucleotide sequences may be screened using hybridization methods to determine their utility as hybridization target or amplification probes.

Stability of DNA duplexes is affected by such factors as base composition, length, and degree of base pair mismatch. Hybridization conditions may be adjusted to allow DNAs of different sequence relatedness to hybridize. The melting temperature ($T_m$) is defined as the temperature when 50% of the duplex molecules have dissociated into their constituent single strands. The melting temperature of a perfectly matched duplex, where the hybridization buffer contains formamide as a denaturing agent, may be estimated by the following equations:

$$T_m(°C.)=81.5+16.6(\log [Na+])+0.41(\% G+C)-0.62(\% \text{ formamide})-500/L \quad \text{(I) DNA-DNA:}$$

$$T_m(°C.)=79.8+18.5(\log [Na+])+0.58(\% G+C)+0.12(\% G+C)^2-0.5(\% \text{ formamide})-820/L \quad \text{(II) DNA-RNA:}$$

$$T_m(°C.)=79.8+18.5(\log [Na+])+0.58(\% G+C)+0.12(\% G+C)^2-0.35(\% \text{ formamide})-820/L \quad \text{(III) RNA-RNA:}$$

where L is the length of the duplex formed, [Na+] is the molar concentration of the sodium ion in the hybridization or washing solution, and % G+C is the percentage of (guanine+cytosine) bases in the hybrid. For imperfectly matched hybrids, approximately 1° C. is required to reduce the melting temperature for each 1% mismatch.

Hybridization experiments are generally conducted in a buffer of pH between 6.8 to 7.4, although the rate of hybridization is nearly independent of pH at ionic strengths likely to be used in the hybridization buffer (Anderson and Young, 1985. supra). In addition, one or more of the following may be used to reduce non-specific hybridization: sonicated salmon sperm DNA or another non-complementary DNA, bovine serum albumin, sodium pyrophosphate, sodium dodecylsulfate (SDS), polyvinyl-pyrrolidone, ficoll and Denhardt's solution. Dextran sulfate and polyethylene glycol 6000 act to exclude DNA from solution, thus raising the effective probe DNA concentration and the hybridization signal within a given unit of time. In some instances, conditions of even greater stringency may be desirable or required to reduce non-specific and/or background hybridization. These conditions may be created with the use of higher temperature, lower ionic strength and higher concentration of a denaturing agent such as formamide.

Stringency conditions can be adjusted to screen for moderately similar fragments such as homologous sequences from distantly related organisms, or to highly similar fragments such as genes that duplicate functional enzymes from closely related organisms. The stringency can be adjusted either during the hybridization step or in the post-hybridization washes. Salt concentration, formamide concentration, hybridization temperature and probe lengths are variables that can be used to alter stringency (as described by the formula above). As a general guideline, high stringency is typically performed at $T_m-5°$ C. to $T_m-20°$ C., moderate stringency at $T_m-20°$ C. to $T_m-35°$ C. and low stringency at $T_m-35°$ C. to $T_m-50°$ C. for duplex >150 base pairs. Hybridization may be performed at low to moderate stringency (25-50° C. below $T_m$), followed by post-hybridization washes at increasing stringencies. Maximum rates of hybridization in solution are determined empirically to occur at $T_m-25°$ C. for DNA-DNA duplex and $T_m-15°$ C. for RNA-DNA duplex. Optionally, the degree of dissociation may be assessed after each wash step to determine the need for subsequent, higher stringency wash steps.

High stringency conditions may be used to select for nucleic acid sequences with high degrees of identity to the disclosed sequences. An example of stringent hybridization conditions obtained in a filter-based method such as a Southern or Northern blot for hybridization of complementary nucleic acids that have more than 100 complementary residues is about 5° C. to 20° C. lower than the thermal melting point ($T_m$) for the specific sequence at a defined ionic strength and pH. Conditions used for hybridization may include about 0.02 M to about 0.15 M sodium chloride, about 0.5% to about 5% casein, about 0.02% SDS or about 0.1% N-laurylsarcosine, about 0.001 M to about 0.03 M sodium citrate, at hybridization temperatures between about 50° C. and about 70° C. More preferably, high stringency conditions are about 0.02 M sodium chloride, about 0.5% casein, about 0.02% SDS, about 0.001 M sodium citrate, at a temperature of about 50° C. Nucleic acid molecules that hybridize under stringent conditions will typically hybridize to a probe based on either the entire DNA molecule or selected portions, e.g., to a unique subsequence, of the DNA.

Stringent salt concentration will ordinarily be less than about 750 mM NaCl and 75 mM trisodium citrate. Increasingly stringent conditions may be obtained with less than about 500 mM NaCl and 50 mM trisodium citrate, to even greater stringency with less than about 250 mM NaCl and 25 mM trisodium citrate. Low stringency hybridization can be obtained in the absence of organic solvent, e.g., formamide, whereas high stringency hybridization may be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. with formamide present. Varying additional parameters, such as hybridization time, the concentration of detergent, e.g., sodium dodecyl sulfate (SDS) and ionic strength, are well known to those skilled in the art. Various levels of stringency are accomplished by combining these various conditions as needed.

The washing steps that follow hybridization may also vary in stringency; the post-hybridization wash steps primarily determine hybridization specificity, with the most critical factors being temperature and the ionic strength of the final wash solution. Wash stringency can be increased by decreasing salt concentration or by increasing temperature. Stringent salt concentration for the wash steps will preferably be less than about 30 mM NaCl and 3 mM trisodium citrate, and most preferably less than about 15 mM NaCl and 1.5 mM trisodium citrate.

Thus, high stringency hybridization and wash conditions that may be used to bind and remove polynucleotides with less than the desired homology to the nucleic acid sequences or their complements that encode the present polypeptides include, for example:

6×SSC at 65° C.;
50% formamide, 4×SSC at 42° C.; or
0.5×SSC, 0.1% SDS at 65° C.;
with, for example, two wash steps of 10-30 minutes each. Useful variations on these conditions will be readily apparent to those skilled in the art.

A person of skill in the art would not expect substantial variation among polynucleotide species provided with the present description because the highly stringent conditions set forth in the above formulae yield structurally similar polynucleotides.

If desired, one may employ wash steps of even greater stringency, including about 0.2×SSC, 0.1% SDS at 65° C. and washing twice, each wash step being about 30 minutes, or about 0.1×SSC, 0.1% SDS at 65° C. and washing twice for 30 minutes. The temperature for the wash solutions will ordinarily be at least about 25° C., and for greater stringency at least about 42° C. Hybridization stringency may be increased further by using the same conditions as in the hybridization steps, with the wash temperature raised about 3° C. to about 5° C., and stringency may be increased even further by using the same conditions except the wash temperature is raised about 6° C. to about 9° C. For identification of less closely related homologs, wash steps may be performed at a lower temperature, e.g., 50° C.

An example of a low stringency wash step employs a solution and conditions of at least 25° C. in 30 mM NaCl, 3 mM trisodium citrate, and 0.1% SDS over 30 minutes. Greater stringency may be obtained at 42° C. in 15 mM NaCl, with 1.5 mM trisodium citrate, and 0.1% SDS over 30 minutes. Even higher stringency wash conditions are obtained at 65° C.–68° C. in a solution of 15 mM NaCl, 1.5 mM trisodium citrate, and 0.1% SDS. Wash procedures will generally employ at least two final wash steps. Additional variations on these conditions will be readily apparent to those skilled in the art (see, for example, U.S. patent publication no. 20010010913).

Stringency conditions can be selected such that an oligonucleotide that is perfectly complementary to the coding oligonucleotide hybridizes to the coding oligonucleotide with at least about a 5-10× higher signal to noise ratio than the ratio for hybridization of the perfectly complementary oligonucleotide to a nucleic acid encoding a polypeptide known as of the filing date of the application. It may be desirable to select conditions for a particular assay such that a higher signal to noise ratio, that is, about 15× or more, is obtained. Accordingly, a subject nucleic acid will hybridize to a unique coding oligonucleotide with at least a 2× or greater signal to noise ratio as compared to hybridization of the coding oligonucleotide to a nucleic acid encoding known polypeptide. The particular signal will depend on the label used in the relevant assay, e.g., a fluorescent label, a colorimetric label, a radioactive label, or the like. Labeled hybridization or PCR probes for detecting related polynucleotide sequences may be produced by oligolabeling, nick translation, end-labeling, or PCR amplification using a labeled nucleotide.

The present description also provides polynucleotide sequences that are capable of hybridizing to the claimed polynucleotide sequences, including any of the polynucleotides within the Sequence Listing, and fragments thereof under various conditions of stringency (see, for example, Wahl and Berger, 1987, supra, pages 399-407; and Kimmel, 1987. *Meth. Enzymol.* 152, 507-511). In addition to the nucleotide sequences in the Sequence Listing, full length cDNA, orthologs, and paralogs of the present nucleotide sequences may be identified and isolated using well-known methods. The cDNA libraries, orthologs, and paralogs of the present nucleotide sequences may be screened using hybridization methods to determine their utility as hybridization target or amplification probes.

Examples

It is to be understood that this description is not limited to the particular devices, machines, materials and methods described. Although particular embodiments are described, equivalent embodiments may be used to practice the claims.

The specification, now being generally described, will be more readily understood by reference to the following examples, which are included merely for purposes of illustration of certain aspects and embodiments of the present description and are not intended to limit the claims or description. It will be recognized by one of skill in the art that a polypeptide that is associated with a particular first trait may also be associated with at least one other, unrelated and inherent second trait which was not predicted by the first trait.

Example I. The Instant Polynucleotides and their Encoded or Predicted Polypeptides The instant polypeptides sequences belong to distinct clades of polypeptides that include members from diverse species. In each case, clade member sequences derived from both eudicots and monocots may be shown to confer increased yield or tolerance to one or more abiotic stresses when the sequences were overexpressed. These studies can demonstrate that evolutionarily conserved genes from diverse species are likely to function similarly (i.e., by regulating similar target sequences and controlling the same traits), and that polynucleotides from one species may be transformed into closely-related or distantly-related plant species to confer or improve traits.

The listed polypeptide sequences may be found within the polypeptide clades of Myb Domain Protein 27 ("AtMYB27"; AT3G53200; G1311), ACBF-like family member RNA-binding protein 45A ("RBP45A"; AT5G54900; G1940), PCF family member TEOSINTE BRANCHED1// CYCLOIDEA//PCF 6 transcription factor 6 ("TCP6"; AT5G41030; G1936), Basic helix-loop-helix protein (bHLH) family member Phytochrome Interacting Factor 3-like 1 ("PIL1": AT2G46970; G1649), GARP family member PHYTOCLOCK 1 ("PCL1"; AT3G46640.3; G2741), TH family member GT-2-Likel ("GTL1"; AT1G33240; G634), AP2 family members Dehydration-Responsive Element-Binding Protein 2H ("DREB2H"; AT2G40350; G1755), and ethylene-responsive transcription factor ERF087 ("ERF087"; AT1G28160; G2292), CCAAT family member Nuclear Transcription Factor Y subunit C-6 ("NF-YC6"; AT5G50480; G1820), Z—CO-like family member CONSTANS-like B-box zinc finger protein ("BBX18", "F3K23.8"; AT2G21320; G1881), HLH/MYC family member Basic Helix-Loop-Helix 60 ("bHLH60"; AT3G57800.2; G2144), Z—CO-like family member CONSTANS-like B-box zinc finger protein ("BBX26", AT1G60250, G1486), bHLH family member bHLH121 (At3g19860, G782), and Putative MethylTransferase 24 ("PMT24" NP_174240, G837).

Orthologs and paralogs of presently disclosed polypeptides may be cloned using compositions provided by the present description according to methods well known in the art. cDNAs can be cloned using mRNA from a plant cell or tissue that expresses one of the present sequences. Appropriate mRNA sources may be identified by interrogating Northern blots with probes designed from the present sequences, after which a library is prepared from the mRNA obtained from a positive cell or tissue. Polypeptide-encoding cDNA is then isolated using, for example, PCR, using primers designed from a presently disclosed gene sequence, or by probing with a partial or complete cDNA or with one or more sets of degenerate probes based on the disclosed sequences. The cDNA library may be used to transform plant cells. Expression of the cDNAs of interest is detected using, for example, microarrays, Northern blots, quantitative PCR, or any other technique for monitoring changes in expression. Genomic clones may be isolated using similar techniques to those.

Examples of orthologs of the *Arabidopsis* polypeptide sequences and their functionally similar orthologs are listed in the instant Tables and the Sequence Listing. In addition to the sequences in the instant Tables and the Sequence Listing, the claimed nucleotide sequences are phylogenetically and structurally similar to sequences listed in the Sequence Listing and can function in a plant by increasing yield, light use efficiency, photosynthetic capacity, photosynthetic rate, photosynthetic resource use efficiency, vigor, and/or biomass as compared to a control plant when ectopically expressed, or overexpressed, in a plant. Since a significant number of these sequences are phylogenetically and sequentially related to each other and may be shown to increase yield from a plant and/or photosynthetic resource use efficiency, one skilled in the art would predict that other similar, phylogenetically related sequences falling within the present clades of polypeptides, including AtMYB27, RBP45A, TCP6, PILL PCL1, GTL1, DREB2H, ERF087, NF-YC6, BBX18, bHLH60, BBX26, bHLH121, or PMT24 clade polypeptide sequences, would also perform similar functions when ectopically expressed.

Background Information for AtMYB27, RBP45A, TCP6, PILL PCL1, GTL1, DREB2H, ERF087, NF-YC6, BBX18, bHLH60, BBX26, bHLH121, or PMT24, and their Clade Member Sequences.

A number of phylogenetically-related sequences have been found in other plant species. The instant Tables list a number of AtMYB27, RBP45A, TCP6, PILL PCL1, GTL1, DREB2H, ERF087, NF-YC6, BBX18, bHLH60, BBX26, bHLH121, or PMT24 clade sequences from diverse species. The tables include the SEQ ID NO: (Column 1), the species from which the sequence was derived and the Gene Identifier ("GID"; Column 2), the percent identity of the polypeptide in Column 1 to the first listed full length polypeptide (SEQ ID NO: 2, 42, 86, 108, 126, 156, 192, 246, 278, 318, 356, 388, 410, or 444), as determined by a BLASTp analysis, for example, with a wordlength (W) of 3, an expectation (E) of 10, and the BLOSUM62 scoring matrix (Henikoff and Henikoff, 1989. *Proc. Natl. Acad. Sci. USA* 89:10915; Henikoff and Henikoff, 1991. *Nucleic Acids Res.* 19: 6565-6572) (Column 3), the amino acid residue coordinates for the conserved domains in amino acid coordinates beginning at the N-terminus, of each of the sequences (Column 4), the conserved domain sequences of the respective polypeptides (Column 5); the SEQ ID NO: of each of the domains (Column 6), and the percentage identity of the conserved domain in Column 5 to the conserved domain of the first listed sequence (as determined by a BLASTp analysis, wordlength (W) of 3, an expectation (E) of 10, and the BLOSUM62 scoring matrix, and with the proportion of identical amino acids in parentheses; Column 7).

Species abbreviations that appear in Columns 2 of the following Tables include: At—*Arabidopsis thaliana*; Bd—*Brachypodium distachyon*; Cc—*Citrus clementina*; Eg—*Eucalyptus grandis*; Gm–*Glycine max*; Os—*Oryza sativa*; Pt—*Populus trichocarpa*; Si—*Setaria italica*; Sl—*Solanum lycopersicum*; Vv—*Vitis vinifera*; Zm—*Zea mays*.

AtMYB27 Clade Polypeptides

TABLE 2

Conserved 'Myb domain 1' of AtMYB27 and closely related sequences

| Col. 1 SEQ ID NO: | Col. 2 Species/ Identifier | Col. 3 Percent identity of polypeptide in Col. 1 to AtMyb27 | Col. 4 Myb domain 1 in amino acid coordinates | Col. 5 Conserved Myb domain 1 | Col. 6 SEQ ID NO: of Myb domain 1 | Col. 7 Percent identity of the Myb domain in Col. 5 to the Myb domain 1 of AtMyb27 |
|---|---|---|---|---|---|---|
| 2 | At/AtMyb27 or AT3G53200.1 | 100% (238/238) | 11-58 | RGPWLEEEDERLVKVI SLLGERRWDSLAIVSG LKRSGKSCRLRWMNYL | 483 | 100% (48/48) |
| 14 | Vv/GSVIVT01033670001 | 72% (83/115) | 8-55 | KGSWLEEEDERLTAF VGLLGERRWDSIARA SGLKRSGKSCRLRWL NYL | 489 | 77% (37/48) |
| 4 | Gm/Glyma10g06680.1 | 44% (106/236) | 8-55 | KGTWLQEEDEQLTSF VTRLGERRWDSLAKV AGLKRSGKSCRLRWM NYL | 484 | 75% (36/48) |
| 6 | Gm/Glyma13g20880.1 | 70% (77/110) | 8-55 | KGTWLQEEDEQLTSF VARLGERRWDSLAKV AGLKRSGKSCRLRWM NYL | 485 | 75% (36/48) |
| 8 | Cc/clementine0.9_029544m | 49% (90/182) | 38-85 | KGPWHEEEDELLVTF VTLFGERRWDYIAKA SGLKRSGKSCRLRWL NYL | 486 | 72% (35/48) |
| 10 | Eg/Eucgr.A01648.1 | 43% (102/234) | 15-62 | KGPWIEQEDEILTAFV TVLGERRWDYIAKTS GLKRSGKSCRLRWKN YL | 487 | 68% (33/48) |

TABLE 2-continued

Conserved 'Myb domain 1' of AtMYB27 and closely related sequences

| Col. 1 SEQ ID NO: | Col. 2 Species/ Identifier | Col. 3 Percent identity of polypeptide in Col. 1 to AtMyb27 | Col. 4 Myb domain 1 in amino acid coordinates | Col. 5 Conserved Myb domain 1 | Col. 6 SEQ ID NO: of Myb domain 1 | Col. 7 Percent identity of the Myb domain in Col. 5 to the Myb domain 1 of AtMyb27 |
|---|---|---|---|---|---|---|
| 12 | Pt/POPTR_0006s12400.1 | 48% (98/203) | 10-57 | KGSWQEEEDERLTAS ATLLGERKWDSIARLS GLMRSGKSCRMRWL NYL | 488 | 68% (33/48) |

TABLE 3

Conserved 'Myb domain 2' of AtMYB27 and closely related sequences

| Col. 1 SEQ ID NO: | Col. 2 Species/ Identifier | Col. 3 Percent identity of polypeptide in Col. 1 to AtMyb27 | Col. 4 Myb domain 2 in amino acid coordinates | Col. 5 Conserved Myb domain 2 | Col. 6 SEQ ID NO: of Myb domain 2 | Col. 7 Percent identity of second Myb domain in Col. 5 to Myb domain 2 of AtMyb27 |
|---|---|---|---|---|---|---|
| 2 | At/AtMyb27 or AT3G53200.1 | 100% (238/238) | 64-109 | RGPMSQEEERIIFQLH ALWGNKWSKIARRL PGRTDNEIKNYWRTHY | 490 | 100% (46/46) |
| 12 | Pt/POPTR_0006s12400.1 | 48% (98/203) | 63-108 | RGHISAEEEQIIIQFHG QWGNKWARIARRLP GRTDNEIKNYWRTHM | 495 | 77% (35/45) |
| 14 | Vv/GSVIVT01033670001 | 72% (83/115) | 61-106 | RCQISAEEEQIILQLH KRWGNKWSWIARSL PGRTDNEIKNYWRTHL | 496 | 76% (35/46) |
| 10 | Eg/Eucgr.A01648.Eg/1 | 43% (102/234) | 68-113 | HGPISPEEERIIIKFHE QWGNKWSRIAEKLP GRTDNEIKNFWKTHL | 494 | 72% (32/44) |
| 4 | Gm/Glyma10g06680.1 | 44% (106/236) | 61-106 | HGHFSVEEEQLIVQL QQQLGNKWAKIARK LPGRTDNEIKNFWRT HL | 491 | 70% (31/44) |
| 6 | Gm/Glyma13g20880.1 | 70% (77/110) | 61-106 | HGHFSVEEEQLIVQL QQELGNKWAKIARK LPGRTDNEIKNYWKT HL | 492 | 68% (31/45) |
| 8 | Cc/clementine0.9_029544m | 49% (90/182) | 91-139 | HGYISTEEEQIIIQLHK NIKIYLHGWSRIARSL PGRTDNEIKNCWRTRI | 493 | 63% (29/46) |

Sequences that are functionally-related and/or closely-related to the polypeptides in the above Tables may be created artificially, semi-synthetically, or may occur naturally by having descended from the same ancestral sequence as the disclosed closely-related sequences, where the polypeptides have the function of conferring increased photosynthetic resource use efficiency to plants.

These functionally-related and/or closely-related AtMYB27 clade polypeptides may be identified by a consensus first Myb domain (Myb domain 1) consensus sequence, SEQ ID NO: 842:

$X^1GX^3WX^5X^6X^7EDEX^{11}LX^{13}X^{14}X^{15}X^{16}X^{17}X^{18}X^{19}GERX^{23}$ $WDX^{26}X^{27}AX^{29}X^{30}X^{31}GLX^{34}RSGKSCRX^{42}RWX^{45}NYL$ where $X^1$=K or R; $X^3$=any amino acid; $X^5$=any amino acid; $X^6$=Q or E; $X^7$=Q or E; $X^{11}$=any amino acid; $X^{13}$=T or V; $X^{14}$=any amino acid; $X^{15}$=any amino acid; $X^{16}$=any amino acid; $X^{17}$=S, A, T or G; $X^{18}$=any amino acid; $X^{19}$=F, I, L, V or M; $X^{23}$=R or K; $X^{26}$=any amino acid; $X^{27}$=I, L, V or M; $X^{29}$=any amino acid; $X^{30}$=any amino acid; $X^{31}$=S or A; $X^{34}$=any amino acid; $X^{42}$=I, L, V or M; and $X^{45}$=any amino acid.

These functionally-related and/or closely-related AtMYB27 clade polypeptides also may be identified by a consensus second Myb domain (Myb domain 2) consensus sequence, SEQ ID NO: 843:

$X^1X^2X^3X^4SX^6EEEX^{10}X^{11}IX^{13}X^{14}X^{15}X^{16}X^{17}X^{18}X^{19}X^{20}$ $X^{21}X^{22}X^{23}X^{24}X^{25}WX^{27}X^{28}IAX^{31}X^{32}LPGRTDNEIKNX^{44}$ $WX^{46}TX^{48}X^{49}$ where $X^1$=any amino acid; $X^2$=any amino acid; $X^3$=any amino acid; $X^4$=F, I, L, V or M; $X^6$=any amino acid; $X^{10}$=any amino acid; $X^{11}$=I, L, V or M; $X^{13}$=F, I, L, V or M; $X^{14}$=Q or K; $X^{15}$=F, I, L, V or M; $X^{16}$=H or Q; $X^{17}$=any amino acid; $X^{18}$=any amino acid; $X^{19}$=any amino acid; $X^{20}$=any amino acid; $X^{21}$=any amino acid; $X^{22}$=any amino acid; $X^{23}$=L or absent; $X^{24}$=H or absent; $X^{25}$=G or absent; $X^{27}$=S or A; $X^{28}$=any amino acid; $X^{31}$=any amino acid; $X^{32}$=any amino acid; $X^{44}$=any amino acid; $X^{46}$=K or R; $X^{48}$=any amino acid; and $X^{49}$=any amino acid.

RBP45A Clade Polypeptides

TABLE 4

Conserved 'RRM1 domain' of RBP45A and closely related sequences

| Col. 1 SEQ ID NO: | Col. 2 Species/ Identifier | Col. 3 Percent identity of polypeptide in Col. 1 to RBP45A | Col. 4 RRM1 domain in amino acid coordinates | Col. 5 Conserved RRM1 domain | Col. 6 SEQ ID NO: of RRM1 domain | Col. 7 Percent identity of RRM1 domain in Col. 5 to RRM1 domain of RBP45A |
|---|---|---|---|---|---|---|
| 42 | At/RBP45A or AT5G54900.1 | 100% (387/387) | 61-141 | SLWIGDLQQWMDE NYIMSVFAQSGEAT SAKVIRNKLTGQSE GYGFIEFVSHSVAER VLQTYNGAPMPSTE QTFRLNWAQAG | 510 | 100% (81/81) |
| 40 | At/AT4G27000.1 | 71% (282/394) | 81-161 | SLWIGDLQPWMDEN YLMNVFGLTGEATA AKVIRNKQNGYSEG YGFIEFVNHATAER NLQTYNGAPMPSSE QAFRLNWAQLG | 509 | 79% (64/81) |
| 44 | Pt/POPTR_0001s45000.1 | 70% (228/323) | 68-148 | SLWIGDLQQWMDE NYILSIFSTTGEVVQ AKVIRNKQTGYPEG YGFIEFVSHAAAERI LQTYNGTPMPNSEQ TFRLNWATLG | 511 | 76% (62/81) |
| 46 | Pt/POPTR_0011s14150.1 | 69% (231/331) | 71-151 | SLWIGDLQQWMDE NYLLSIFSATGEIVQ AKVIRNKQTGYPEG YGFIEFVSRAAAERI LQTYNGTPMPNSEQ AFRLNWATLG | 512 | 72% (59/81) |
| 66 | Sl/Solyc02g080420.2.1 | 66% (216/325) | 80-160 | SLWIGDLQFWMDEQ YLLNCFAQTGEVTS AKVIRNKQSGQSEG YGFIEFISHAAAERN LQAYNGTLMPNIEQ NFRLNWASLG | 522 | 72% (59/81) |
| 68 | Sl/Solyc10g005260.2.1 | 65% (218/333) | 77-157 | TLWIGDLQFWMDE QYLYSCFAQTGEVV SAKVIRNKQTQQSE GYGFIEFNSHAAAER NLQAYNGTLMPNIE QNFRLNWASLG | 523 | 71% (58/81) |
| 70 | Sl/Solyc03g031720.2.1 | 64% (215/335) | 73-153 | SLWIGDLQFWMDEQ YIQNCFAHTGEVAS VKVIRNKQSGQSEG YGFVEFISHAAAERN LQTYNGSMMPNSEQ PFRLNWASLG | 524 | 70% (57/81) |

TABLE 4-continued

Conserved 'RRM1 domain' of RBP45A and closely related sequences

| Col. 1 SEQ ID NO: | Col. 2 Species/ Identifier | Col. 3 Percent identity of polypeptide in Col. 1 to RBP45A | Col. 4 RRM1 domain in amino acid coordinates | Col. 5 Conserved RRM1 domain | Col. 6 SEQ ID NO: of RRM1 domain | Col. 7 Percent identity of RRM1 domain in Col. 5 to RRM1 domain of RBP45A |
|---|---|---|---|---|---|---|
| 48 | Sl/Solyc07g064510.2.1 | 67% (218/324) | 82-162 | SLWIGDLQYWMDES YLSTCFYHTGELVS AKVIRNKQSGQSEG YGFLEFRSHAAAET VLQTYNGALMPNVE QNFRMNWASLG | 513 | 69% (56/81) |
| 62 | Gm/Glyma13g27570.1 | 64% (214/331) | 67-147 | TLWIGDLQYWMDE NYLYTCFAHTGEVT SVKVIRNKQTSQSEG YGFIEFNSRAGAERI LQTYNGAIMPNGGQ SFRLNWATFS | 520 | 69% (56/81) |
| 24 | Os/LOC_Os08g09100.1 | 63% (206/325) | 96-174 | TLWIGDLQYWMDE NYISACFAPTGELQS VKLIRDKQTGQLQG YGFIEFTSHAGAERV LQTYNGAMMPNVE QTYRLNWAS | 501 | 69% (56/81) |
| 54 | Pt/POPTR_0004s01690.1 | 61% (213/349) | 78-158 | TLWIGDLQYWMDE NYIASCFAHTGEVAS VKIIRNKQTSQIEGY GFIEMTSHGAAERIL QTYNGTPMPNGEQN FRLNWASFS | 516 | 69% (56/81) |
| 52 | At/AT1G11650.2 | 63% (206/325) | 63-144 | TLWIGDLQYWMDE NFLYGCFAHTGEMV SAKVIRNKQTGQVE GYGFIEFASHAAAER VLQTFNNAPIPSFPD QLFRLNWASLS | 515 | 68% (56/82) |
| 60 | Gm/Glyma17g01800.1 | 66% (218/327) | 66-146 | TLWIGDLQYWMDE NYLYTCFAHTGELA SVKVIRNKQTSQSEG YGFIEFTSRAGAERV LQTYNGTIMPNGGQ NFRLNWATFS | 519 | 67% (55/81) |
| 64 | Gm/Glyma15g11380.1 | 64% (215/333) | 68-148 | TLWIGDLQYWMDE NYLYTCFAHTGEVS SVKVIRNKQTSQSEG YGFIEFNSRAGAERI LQTYNGAIMPNGGQ SFRLNWATFS | 521 | 67% (55/81) |
| 38 | Zm/GRMZM2G002874_T01 | 68% (219/322) | 71-151 | TLWIGDLQYWMDE NYLYSCFSQAGEVIS VKIIRNKQTGQPEGY GFIEFSNHAVAEQVL QNYNGQMMPNVNQ PFKLNWATSG | 508 | 66% (54/81) |
| 58 | Gm/Glyma07g38940.1 | 66% (217/326) | 62-142 | TLWIGDLQYWMDE NYLYTCLAHTGEVA SVKVIRNKQTSQSEG YGFIEFTSRAGAERV LQTYNGTIMPNGGQ NFRLNWATLS | 518 | 66% (54/81) |
| 50 | Eg/Eucgr.F03462.1 | 69% (226/323) | 65-145 | SLWIGDLQPHMDET YLLNCFAHSGEVLS AKVIRNKQTALPEG | 514 | 65% (53/81) |

TABLE 4-continued

Conserved 'RRM1 domain' of RBP45A and closely related sequences

| Col. 1 SEQ ID NO: | Col. 2 Species/ Identifier | Col. 3 Percent identity of polypeptide in Col. 1 to RBP45A | Col. 4 RRM1 domain in amino acid coordinates | Col. 5 Conserved RRM1 domain | Col. 6 SEQ ID NO: of RRM1 domain | Col. 7 Percent identity of RRM1 domain in Col. 5 to RRM1 domain of RBP45A |
|---|---|---|---|---|---|---|
| | | | | YGFIEFMTRAAAERI LQTYNGTLMPNSDQ NFRLNWATLG | | |
| 36 | Os/LOC_Os03g37270.1 | 67% (218/323) | 68-148 | TLWIGDLQFWMEEN YLYNCFSQAGELISA KIIRNKQTGQPEGYG FIEFGSHAIAEQVLQ GYNGQMMPNGNQV FKLNWATSG | 507 | 65% (53/81) |
| 56 | Eg/Eucgr.D01310.1 | 63% (193/303) | 93-171 | TLWIGDLQYWMDE AYLGTCFAATGEVA NVKVIRNKQTMQPE GYGFIEFYTRAAAER VLQTYNGAIMPNGG QSFRLNWAS | 517 | 64% (52/81) |
| 26 | Zm/GRMZM2G426591_T01 | 62% (204/324) | 122-200 | TLWIGDLQYWMDD NYIYGCFASTGEVQ NVKLIRDKHTGQLQ GYGFIEFISRAAAER VLQTYNGTMMPNV ELPFRLNWAS | 502 | 62% (51/81) |
| 22 | Bd/Bradi3g15180.1 | 56% (213/376) | 99-177 | TLWIGDLQYWMDE NYVYGCFAHTGEVQ SVKLIRDKQTGQLQ GYGFVEFTTRAGAE RVLQTYNGATMPN VEMPYRLNWAS | 500 | 61% (50/81) |
| 16 | Bd/Bradi5g22410.1 | 61% (201/327) | 89-167 | TLWIGDLQYWMDE TYIHGCFASTGELQS VKLIRDKQTGQLQG YGFVEFTSHAAAER VLQGYNGHAMPNV DLAYRLNWAS | 497 | 60% (49/81) |
| 30 | Os/LOC_Os07g33330.1 | 58% (205/348) | 129-210 | SLWIGDLQYWMDES YLSNAFAPMGQQVT SVKVIRNKQSGHSE GYGFIEFQSHAAAE YALANFNGRMMLN VDQLFKLNWASSG | 504 | 59% (49/82) |
| 18 | Zm/GRMZM2G012628_T01 | 58% (191/329) | 93-171 | TLWIGDLQYWMDE NYVFGCFSNTGEVQ NVKLIRDKNSGQLQ GYGFVEFTSRAAAE RVLQTYNGQMMPN VDLTFRLNWAS | 498 | 59% (48/81) |
| 20 | Zm/GRMZM2G058098_T02 | 58% (192/331) | 87-165 | TLWIGDLQYWMDD NYVFGCFSNTGEVQ NVKLIRDKNSGQLQ GYGFVEFTSRAAAE RVLQTYNGQMMPN VDLTFRLNWAS | 499 | 58% (47/81) |
| 32 | Zm/GRMZM2G127510_T01 | 53% (191/354) | 115-197 | TLWIGDLQHWMDE NYLHYNAFAAVAQ QIASVKIIRNKQTGH SEGYGFIEFYSRAAA EHTLMNFNGQMMP NVEMTFKLNWASAS | 505 | 57% (48/83) |

TABLE 4-continued

Conserved 'RRM1 domain' of RBP45A and closely related sequences

| Col. 1 SEQ ID NO: | Col. 2 Species/ Identifier | Col. 3 Percent identity of polypeptide in Col. 1 to RBP45A | Col. 4 RRM1 domain in amino acid coordinates | Col. 5 Conserved RRM1 domain | Col. 6 SEQ ID NO: of RRM1 domain | Col. 7 Percent identity of RRM1 domain in Col. 5 to RRM1 domain of RBP45A |
|---|---|---|---|---|---|---|
| 34 | Zm/GRMZM2G169615_T01 | 55% (188/338) | 147-229 | TLWIGDLQYWMDE NYLHYNAFAPVAQQ IASVKIIRNKQTGHS EGYGFIEFYSQAAAE HTLMNFNGQMMPNI EMAFKLNWASAS | 506 | 56% (47/83) |
| 28 | Bd/Bradi1g26210.1 | 55% (181/324) | 115-197 | SLWIGDLQYWMDE AYLHNAFAPMGPQQ VASVKIIRNKQTGQP EGYGFIEFHSRAAAE YALASFNGHAMPNV DLPFKLNWASAS | 503 | 56% (47/83) |

TABLE 5

Conserved 'RRM2 domain' of RBP45A and closely related sequences

| Col. 1 SEQ ID NO: | Col. 2 Species/ Identifier | Col. 3 Percent identity of polypeptide in Col. 1 to RBP45A | Col. 4 RRM2 domain in amino acid coordinates | Col. 5 Conserved RRM2 domain | Col. 6 SEQ ID NO: of RRM2 domain | Col. 7 Percent identity of RRM2 domain in Col. 5 to RRM2 domain of RBP45A |
|---|---|---|---|---|---|---|
| 42 | At/RBP45A or AT5G54900.1 | 100% (387/387) | 153-232 | DHTIFVGDLAPEVTD YMLSWITKNVYGSV KGAKVVLDRTTGRS KGYGFVRFADENEQ MRAMTEMNGQYCS TRPMRIGPAA | 538 | 100% (80/80) |
| 40 | At/AT4G27000.1 | 71% (282/394) | 172-251 | EHTVFVGDLAPDVT DHMLTETFKAVYSS VKGAKVVNDRTTG RSKGYGFVRFADES EQIRAMTEMNGQYC SSRPMRTGPAA | 537 | 83% (67/80) |
| 44 | Pt/POPTR_0001s45000.1 | 70% (228/323) | 159-238 | DYTVFIGDLAADVN DYLLQETFRNVYSS VKGAKVVTDRVTG RSKGYGFVRFADEN EQMRAMVEMNGQY CSTRPMRIGPAA | 539 | 82% (66/80) |
| 46 | Pt/POPTR_0011s14150.1 | 69% (231/331) | 162-241 | DFTVFVGDLAADVN DYLLQETFRNVYPS VKGAKVVTDRVTG RSKGYGFIRFADENE QRRAMVEMNGQYC STRPMRIGPAA | 540 | 81% (65/80) |
| 50 | Eg/Eucgr.F03462.1 | 69% (226/323) | 156-235 | DYTIFVGDLAADVT DHMLQETFRAHYPS VKGAKIVIDRTTGRS KGYGFVRFGDETEQ LRAMTEMNGMYCS SRPMRIGPAA | 542 | 78% (63/80) |

TABLE 5-continued

Conserved 'RRM2 domain' of RBP45A and closely related sequences

| Col. 1 SEQ ID NO: | Col. 2 Species/ Identifier | Col. 3 Percent identity of polypeptide in Col. 1 to RBP45A | Col. 4 RRM2 domain in amino acid coordinates | Col. 5 Conserved RRM2 domain | Col. 6 SEQ ID NO: of RRM2 domain | Col. 7 Percent identity of RRM2 domain in Col. 5 to RRM2 domain of RBP45A |
|---|---|---|---|---|---|---|
| 38 | Zm/GRMZM2G002874_T01 | 68% (219/322) | 162-241 | DYTIFVGDLASDVTDFILQDTFKSRYPSVKGAKVVFDRTTGRSKGYGFVKFADSDEQTRAMTEMNGQYCSSRAMRLGPAS | 536 | 77% (62/80) |
| 36 | Os/LOC_Os03g37270.1 | 67% (218/323) | 159-238 | DYTIFVGDLASDVTDLILQDTFKAHYQSVKGAKVVFDRSTGRSKGYGFVKFGDLDEQTRAMTEMNGQYCSSRPMRIGPAS | 535 | 77% (62/80) |
| 52 | At/AT1G11650.2 | 63% (206/325) | 154-233 | DYTIFVGDLAADVTDYILLETFRASYPSVKGAKVVIDRVTGRTKGYGFVRFSDESEQIRAMTEMNGVPCSTRPMRIGPAA | 543 | 77% (62/80) |
| 48 | Sl/Solyc07g064510.2.1 | 67% (218/324) | 172-251 | EYTIFVGDLAADVTDYVLQETFKPVYSSVKGAKVVTDRITGRTKGYGFVKFSDESEQLRAMTEMNGVLCSSRPMRIGPAA | 541 | 76% (61/80) |
| 70 | Sl/Solyc03g031720.2.1 | 64% (215/335) | 164-243 | EYTIFVGDLAADVTDYMLQETFRANYPSVKGAKVVTDRVTGRTKGYGFVKFADESEQLHAMTEMNGKFCSTRPMRIGPAA | 552 | 76% (61/80) |
| 66 | Sl/Solyc02g080420.2.1 | 66% (216/325) | 171-250 | EYTIFVGDLAADVSDYMLQETFRANYPSVKGAKVVTDKATGRTKGYGFVKFGDESEQLRAMTEMNGQFCSTRPMRIGPAA | 550 | 75% (60/80) |
| 58 | Gm/Glyma07g38940.1 | 66% (217/326) | 153-232 | DHTIFVGDLAADVTDYLLQETFRARYPSIKGAKVVIDRLTGRTKGYGFVRFGDESEQVRAMTEMQGVLCSTRPMRIGPAS | 546 | 75% (60/80) |
| 68 | Sl/Solyc10g005260.2.1 | 65% (218/333) | 168-247 | EYTIFVGDLAADVTDYMLQETFRPNYPSIKGAKVVTDRATGHTKGYGFVRFGDESEQLRAMTEMNGKFCSTRPMRIGPAA | 551 | 75% (60/80) |
| 62 | Gm/Glyma13g27570.1 | 64% (214/331) | 159-238 | DYTIFVGDLAADVTDYLLQETFRARYNSVKGAKVVIDRLTGRTKGYGFVRFSDESEQVRAMTEMQGVLCSTRPMRIGPAS | 548 | 75% (60/80) |
| 64 | Gm/Glyma15g11380.1 | 64% (215/333) | 160-239 | DYTIFVGDLAADVTDYLLQETFRARYNSVKGAKVVIDRLTGRTKGYGFVRFSEESEQ | 549 | 75% (60/80) |

TABLE 5-continued

Conserved 'RRM2 domain' of RBP45A and closely related sequences

| Col. 1 SEQ ID NO: | Col. 2 Species/ Identifier | Col. 3 Percent identity of polypeptide in Col. 1 to RBP45A | Col. 4 RRM2 domain in amino acid coordinates | Col. 5 Conserved RRM2 domain | Col. 6 SEQ ID NO: of RRM2 domain | Col. 7 Percent identity of RRM2 domain in Col. 5 to RRM2 domain of RBP45A |
|---|---|---|---|---|---|---|
| | | | | MRAMTEMQGVLCS TRPMRIGPAS | | |
| 60 | Gm/Glyma17g01800.1 | 66% (218/327) | 157-236 | DHTIFVGDLAADVT DYLLQETFRARYPS AKGAKVVIDRLTGR TKGYGFVRFGDESE QVRAMSEMQGVLC STRPMRIGPAS | 547 | 73% (59/80) |
| 30 | Os/LOC_Os07g33330.1 | 58% (205/348) | 222-301 | EHTIFVGDLASDVTD SMLEEAFKTSYPSVR GAKVVFDKVTGRSK GYGFVRFGDENEQT RAMTEMNGATLSTR QMRLGPAA | 532 | 73% (59/80) |
| 24 | Os/LOC_Os08g09100.1 | 63% (206/325) | 184-263 | DYTIFVGDLAADVT DYILQETFRVHYPSV KGAKVVTDKMTMR SKGYGFVKFGDPSE QARAMTEMNGMVC SSRPMRIGPAA | 529 | 72% (58/80) |
| 26 | Zm/GRMZM2G426591_T01 | 62% (204/324) | 210-289 | DYTIFVGDLAADVT DYVLQETFRAHYPS VKGAKVVTDKLTM RTKGYGFVKFGDPN EQARAMTEMNGML CSSRPMRIGPAA | 530 | 72% (58/80) |
| 16 | Bd/Bradi5g22410.1 | 61% (201/327) | 177-256 | DYTIFVGDLAADVT DYILQETFRVHYPSV KGAKVVTDKMTMR SKGYGFVKFGDPTE QARAMTEMNGMPC SSRPMRIGPAA | 525 | 72% (58/80) |
| 54 | Pt/POPTR_0004s01690.1 | 61% (213/349) | 168-247 | DFTIFVGDLAADVT DFMLQETFRAHFPS VKGAKVVIDRLTGR TKGYGFVRFGDESE QLRAMTEMNGAFCS TRPMRVGLAS | 544 | 72% (58/80) |
| 22 | Bd/Bradi3g15180.1 | 56% (213/376) | 187-266 | DYTIFVGDLAADVT DYILQETFRVHYPSV KGAKVVTDKLTMR SKGYGFVKFSDPTE QTRAMTEMNGMVC SSRPMRIGPAA | 528 | 72% (58/80) |
| 34 | Zm/GRMZM2G169615_T01 | 55% (188-338) | 240-319 | DHAIFVGDLAPDVT DSMLEDVFRANYPS VRGAKVVVDRITGR PKGYGFVHFGDLNE QARAMTEMNGMML STRKMRIGAAA | 534 | 72% (58/80) |
| 28 | Bd/Bradi1g26210.1 | 55% (181/324) | 208-287 | DHTIFVGDLASDVT DSMLQEIFKASYPSV RGANVVTDRATGRS KGYGFVRFGDVNEQ TRAMTEMNGVTLSS RQLRIGPAA | 531 | 72% (58/80) |

TABLE 5-continued

Conserved 'RRM2 domain' of RBP45A and closely related sequences

| Col. 1 SEQ ID NO: | Col. 2 Species/ Identifier | Col. 3 Percent identity of polypeptide in Col. 1 to RBP45A | Col. 4 RRM2 domain in amino acid coordinates | Col. 5 Conserved RRM2 domain | Col. 6 SEQ ID NO: of RRM2 domain | Col. 7 Percent identity of RRM2 domain in Col. 5 to RRM2 domain of RBP45A |
|---|---|---|---|---|---|---|
| 20 | Zm/GRMZM2G058098_T02 | 58% (192/331) | 175-254 | DYTIFVGDLAADVT DYLLQETFRVHYPS VKGAKVVTDKLTM RTKGYGFVKFGDPT EQARAMTEMNGMP CSSRPMRIGPAA | 527 | 71% (57/80) |
| 18 | Zm/GRMZM2G012628_T01 | 58% (191/329) | 181-260 | EYTIFVGDLAADVT DYLLQETFRVHYPS VKGAKVVTDKLTM RTKGYGFVKFGDPT EQARAMTEMNGMP CSSRPMRIGPAA | 526 | 70% (56/80) |
| 32 | Zm/GRMZM2G127510_T01 | 53% (191/354) | 208-287 | DRTIFVGDLAHDVT DSMLEDVFRAKYPS VRGANVVVDRMTG WPKGFGFVRFGDLN EQARAMTEMNGML LSTRQMRIGAAA | 533 | 68% (55/80) |
| 56 | Eg/Eucgr.D01310.1 | 63% (193/303) | 182-261 | DYTIFVGDLASDVT DYMLQEMFRGRYPS VRSAKVVMDRLTSR TKGYGFVKFGDESE QIRAMSEMNGVFLS TRPMRIGLAT | 545 | 67% (54/80) |

TABLE 6

Conserved 'RRM3 domain' of RBP45A and closely related sequences

| Col. 1 SEQ ID NO: | Col. 2 Species/ Identifier | Col. 3 Percent identity of polypeptide in Col. 1 to RBP45A | Col. 4 RRM3 domain in amino acid coordinates | Col. 5 Conserved RRM3 domain | Col. 6 SEQ ID NO: of RRM3 domain | Col. 7 Percent identity of RRM3 domain in Col. 5 to RRM3 domain of RBP45A |
|---|---|---|---|---|---|---|
| 42 | At/RBP45A or AT5G54900.1 | 100% (387/387) | 260-332 | TTIFVGGLDANVTD DELKSIFGQFGELLH VKIPPGKRCGFVQY ANKASAEHALSVLN GTQLGGQSIRLSWG RS | 566 | 100% (73/73) |
| 40 | At/AT4G27000.1 | 71% (282/394) | 278-350 | TTIFVGAVDQSVTED DLKSVFGQFGELVH VKIPAGKRCGFVQY ANRACAEQALSVLN GTQLGGQSIRLSWG RS | 565 | 83% (61/73) |
| 50 | Eg/Eucgr.F03462.1 | 69% (226/323) | 265-337 | TTIFVGGLDPSVSDD LLRQVFSQYGELHH VKIPPGKRCGFVQFT SRACAEQALLMLNG TQLGGQSIRLSWGRS | 570 | 75% (55/73) |

TABLE 6-continued

Conserved 'RRM3 domain' of RBP45A and closely related sequences

| Col. 1 SEQ ID NO: | Col. 2 Species/ Identifier | Col. 3 Percent identity of polypeptide in Col. 1 to RBP45A | Col. 4 RRM3 domain in amino acid coordinates | Col. 5 Conserved RRM3 domain | Col. 6 SEQ ID NO: of RRM3 domain | Col. 7 Percent identity of RRM3 domain in Col. 5 to RRM3 domain of RBP45A |
|---|---|---|---|---|---|---|
| 38 | Zm/GRMZM2G002874_T01 | 68% (219/322) | 271-343 | TTVFVGGLDPSVTD ELLKQTFSPYGELLY VKIPVGKRCGFVQY SNRASAEEAIRVLNG SQLGGQSIRLSWGRS | 564 | 75% (55/73) |
| 66 | Sl/Solyc02g080420.2.1 | 66% (216/325) | 278-350 | TTIFVGNLDSNITDE HLRQIFGHYGQLLH VKIPVGKRCGFIQFA DRSCAEEALRVLNG TQLGGQSIRLSWGRS | 578 | 73% (54/73) |
| 60 | Gm/Glyma17g01800.1 | 66% (218/327) | 265-337 | TTIFVGNLDPNVTDD HLRQVFGQYGELVH VKIPAGKRCGFVQF ADRSCAEEALRVLN GTLLGGQNVRLSWG RS | 575 | 73% (54/73) |
| 70 | Sl/Solyc03g031720.2.1 | 64% (215/335) | 271-343 | TTIFVGNLDANVTD DHLRQVFGNYGQLL HVKIPVGKRCGFVQ FADRSCAEEALRAL SGTQLGGQTIRLSW GRS | 580 | 73% (54/73) |
| 46 | Pt/POPTR_0011s14150.1 | 69% (231/331) | 270-342 | TTIFVGALDPSVTDD TLRAVFSKYGELVH VKIPAGKRCGFVQF ANRTSAEQALSMLN GTQIAGQNIRLSWG RS | 568 | 72% (53/73) |
| 36 | Os/LOC_Os03g37270.1 | 67% (218/323) | 268-340 | TTVFVGGLDPSVTD EVLKQAFSPYGELV YVKIPVGKRCGFVQ YSNRASAEEAIRML NGSQLGGQSIRLSW GRS | 563 | 72% (53/73) |
| 58 | Gm/Glyma07g38940.1 | 66% (217/326) | 261-333 | TTIFVGNLDPNVTDD HLRQVFGHYGELVH VKIPAGKRCGFVQF ADRSCAEEALRVLN GTLLGGQNVRLSWG RS | 574 | 72% (53/73) |
| 62 | Gm/Glyma13g27570.1 | 64% (214/331) | 269-341 | TTIFVGNLDPNVTDD HLRQVFSQYGELVH VKIPAGKRCGFVQF ADRSCAEEALRVLN GTLLGGQNVRLSWG RS | 576 | 72% (53/73) |
| 64 | Gm/Glyma15g11380.1 | 64% (215/333) | 270-342 | TTIFVGNLDPNVTDD HLRQVFSQYGELVH VKIPAGKRCGFVQF ADRSCAEEALRVLN GTLLGGQNVRLSWG RS | 577 | 72% (53/73) |
| 56 | Eg/Eucgr.D01310.1 | 63% (193/303) | 291-363 | KTVFVGGLDPNVTD DHLRQVFGQYGEIV QVKIPPGKRCGFVQF ADRSCAEEALRMLN GTQLGGQNIRLSWG RS | 573 | 72% (53/73) |

TABLE 6-continued

Conserved 'RRM3 domain' of RBP45A and closely related sequences

| Col. 1 SEQ ID NO: | Col. 2 Species/ Identifier | Col. 3 Percent identity of polypeptide in Col. 1 to RBP45A | Col. 4 RRM3 domain in amino acid coordinates | Col. 5 Conserved RRM3 domain | Col. 6 SEQ ID NO: of RRM3 domain | Col. 7 Percent identity of RRM3 domain in Col. 5 to RRM3 domain of RBP45A |
|---|---|---|---|---|---|---|
| 54 | Pt/POPTR_0004s01690.1 | 61% (213/349) | 276-348 | TTIFVGNLDSNVMD DHLKELFGQYGQLL HVKIPAGKRCGFVQ FADRSSAEEALKML NGAQLSGQNIRLSW GRN | 572 | 72% (53/73) |
| 44 | Pt/POPTR_0001s45000.1 | 70% (228/323) | 267-339 | TTIFVGALDPSVTDD TLRAVFSKYGELVH VKIPAGKRCGFVQF ANRTCAEQALSMLN GTQIAGQNIRLSWG RS | 567 | 71% (52/73) |
| 48 | Sl/Solyc07g064510.2.1 | 67% (218/324) | 279-351 | TTIFVGGLDPSVAEE HLRQVFSPYGELVH VKIVAGKRCGFVQF GSRASAEQALSSLN GTQLGGQSIRLSWG RS | 569 | 71% (52/73) |
| 68 | Sl/Solyc10g005260.2.1 | 65% (218/333) | 274-346 | TTIFVGNLDASVTDD HLRQVFGNYGQLLH VKIPLGKRCGFVQFT DRSCAEEALNALSG TQLGGQTIRLSWGRS | 579 | 71% (52/73) |
| 52 | At/AT1G11650.2 | 63% (206/325) | 261-333 | TTVFVGGLDASVTD DHLKNVFSQYGEIV HVKIPAGKRCGFVQ FSEKSCAEEALRML NGVQLGGTTVRLSW GRS | 571 | 69% (51/73) |
| 26 | Zm/GRMZM2G426591_T01 | 62% (204/324) | 315-387 | TTIFVGGLDPNVTED MLKQVFTPYGDVV HVKIPVGKRCGFVQ YANRSSAEEALVILQ GTLVGGQNVRLSW GRS | 558 | 69% (51/73) |
| 24 | Os/LOC_Os08g09100.1 | 63% (206/325) | 289-361 | TTIFVGGLDPSVTDD MLKQVFTPYGDVV HVKIPVGKRCGFVQ FANRASADEALVLL QGTLIGGQNVRLSW GRS | 557 | 68% (50/73) |
| 16 | Bd/Bradi5g22410.1 | 61% (201/327) | 284-356 | TTIFVGGLDPNVTED ALKQVFAPYGEVIH VKIPVGKRCGFVQF VNRPSAEQALQMLQ GTPIGGQNVRLSWG RS | 553 | 68% (50/73) |
| 22 | Bd/Bradi3g15180.1 | 56% (213/376) | 293-365 | TTIFVGGLDPNVTED MLKQVFAPYGEVV HVKIPVGKRCGFVQ YASRSSEEALLML QGTVIGGQNVRLSW GRS | 556 | 68% (50/73) |
| 30 | Os/LOC_Os07g33330.1 | 58% (205/348) | 332-404 | TTIFVGGLDSNVNED HLKQVFTPYGEIGY VKIPLGKRCGFVQFT SRSSAEEAIRVLNGS QIGGQQVRLSWGRT | 560 | 64% (47/73) |

TABLE 6-continued

Conserved 'RRM3 domain' of RBP45A and closely related sequences

| Col. 1 SEQ ID NO: | Col. 2 Species/ Identifier | Col. 3 Percent identity of polypeptide in Col. 1 to RBP45A | Col. 4 RRM3 domain in amino acid coordinates | Col. 5 Conserved RRM3 domain | Col. 6 SEQ ID NO: of RRM3 domain | Col. 7 Percent identity of RRM3 domain in Col. 5 to RRM3 domain of RBP45A |
|---|---|---|---|---|---|---|
| 18 | Zm/GRMZM2G012628_T01 | 58% (191/329) | 288-360 | TTIFVGGLDPNVTED TLKQVFSPYGEVVH VKIPVGKRCGFVQF VTRPSAEQALLMLQ GALIGAQNVRLSWG RS | 554 | 64% (47/73) |
| 20 | Zm/GRMZM2G058098_T02 | 58% (192/331) | 282-354 | TTIFVGGLDPNVTED VLKQAFSPYGEVIH VKIPVGKRCGFVQF VTRPSAEQALLMLQ GALIGAQNVRLSWG RS | 555 | 64% (47/73) |
| 34 | Zm/GRMZM2G169615_T01 | 55% (188/338) | 351-423 | TTVFVGGLDSNVDE EYLRQIFTPYGEISY VKIPVGKHCGFVQF TSRSCAEEAIQMLN GSQIGGQKARLSWG RS | 562 | 58% (43/73) |
| 32 | Zm/GRMZM2G127510_T01 | 53% (191/354) | 319-391 | TTVFVGGLDSNVNE EYLRQIFTPYGEISY VKIPVGKHCGFVQF TSRSCAEEAIRMLNG SQVGGQKVRLSWG RS | 561 | 58% (43/73) |
| 28 | Bd/Bradi1g26210.1 | 55% (181/324) | 320-392 | TTIFVGGLDSNIDEN YLRQVFTPYGEVGY VKIPVGKRCGFVQF TSRSCAEEAINALNG TPIGGNNVRLSWGRS | 559 | 57% (42/73) |

These functionally-related and/or closely-related RBP45A clade polypeptides may be identified by a consensus first RRM domain (RRM1 domain) sequence, SEQ ID NO: 844:

$X^1$LWIGDLQX$^9$X$^{10}$MX$^{12}$X$^{13}$X$^{14}$X$^{15}$X$^{16}$X$^{17}$X$^{18}$X$^{19}$X$^{20}$X$^{21}$X$^{22}$ $X^{23}$X$^{24}$X$^{25}$X$^{26}$X$^{27}$X$^{28}$X$^{29}$X$^{30}$X$^{31}$X$^{32}$KX$^{34}$IRX$^{37}$KX$^{39}$X$^{40}$ $X^{41}$X$^{42}$X$^{43}$X$^{44}$GYGFX$^{49}$EX$^{51}$X$^{52}$X$^{53}$X$^{54}$X$^{55}$X$^{56}$AEX$^{59}$X$^{60}$

LX$^{62}$X$^{63}$X$^{64}$NX$^{66}$X$^{67}$X$^{68}$X$^{69}$X$^{70}$X$^{71}$X$^{72}$X$^{73}$X$^{74}$X$^{75}$X$^{76}$

X$^{77}$X$^{78}$X$^{79}$NWAX$^{83}$X$^{84}$X$^{85}$ where $X^1$=S or T; $X^9$=any amino acid; $X^{10}$=H or W; $X^{12}$=D or E; $X^{13}$=D or E; $X^{14}$=any amino acid; $X^{15}$=F or Y; $X^{16}$=I, L, V or M; $X^{17}$=H or absent; $X^{18}$=any amino acid; $X^{19}$=any amino acid; $X^{20}$=any amino acid; $X^{21}$=F, I, L, V or M; $X^{22}$=any amino acid; $X^{23}$=any amino acid; $X^{24}$=any amino acid; $X^{25}$=A or G; $X^{26}$=P or absent; $X^{27}$=Q or absent; $X^{28}$=E or Q; $X^{29}$=any amino acid; $X^{30}$=any amino acid; $X^{31}$=any amino acid; $X^{32}$=any amino acid; $X^{34}$=I, L, V or M; $X^{37}$=N or D; $X^{39}$=any amino acid; $X^{40}$=any amino acid; $X^{41}$=any amino acid; $X^{42}$=any amino acid; $X^{43}$=any amino acid; $X^{44}$=E or Q; $X^{49}$=I, L, V or M; $X^{51}$=F, I, L, V or M; $X^{52}$=any amino acid; $X^{53}$=any amino acid; $X^{54}$=H, Q or R; $X^{55}$=A, S or G; $X^{56}$=any amino acid; $X^{59}$=any amino acid; $X^{60}$=any amino acid; $X^{62}$=any amino acid; $X^{63}$=any amino acid; $X^{64}$=F or Y; $X^{66}$=any amino acid; $X^{67}$=any amino acid; $X^{68}$=any amino acid; $X^{69}$=I, L, V or M; $X^{70}$=any amino acid; $X^{71}$=any amino acid; $X^{72}$=any amino acid; $X^{73}$=P or absent; $X^{74}$=any amino acid; $X^{75}$=any amino acid; $X^{76}$=any amino acid; $X^{77}$=F or Y; $X^{78}$=K or R; $X^{79}$=I, L, V or M; $X^{83}$=any amino acid or absent; $X^{84}$=any amino acid or absent; and $X^{85}$=S or G.

These functionally-related and/or closely-related RBP45A clade polypeptides also may be identified by a consensus second RRM domain (RRM2 domain) sequence, SEQ ID NO: 845:

$X^1$X$^2$X$^3$X$^4$FX$^6$GDLAX$^{11}$X$^{12}$VX$^{14}$DX$^{16}$X$^{17}$LX$^{19}$X$^{20}$X$^{21}$FX$^{23}$X$^{24}$ $X^{25}$X$^{26}$X$^{27}$SX$^{29}$X$^{30}$X$^{31}$AX$^{33}$X$^{34}$VX$^{36}$DX$^{38}$X$^{39}$TX$^{41}$X$^{42}$X$^{43}$

KGX$^{46}$GFX$^{49}$X$^{50}$FX$^{52}$X$^{53}$X$^{54}$X$^{55}$EQX$^{58}$X$^{59}$AMX$^{62}$EMX$^{65}$GX$^{67}$

X$^{68}$X$^{69}$SX$^{71}$SX$^{71}$RX$^{73}$X$^{74}$RX$^{76}$GX$^{78}$AX$^{80}$ where $X^1$=E or D; $X^2$=any amino acid; $X^3$=A or T; $X^4$=I, L, V or M; $X^6$=I, L, V or M; $X^{11}$=any amino acid; $X^{12}$=E or D; $X^{14}$=any amino acid; $X^{16}$=I, L, V or M; $X^{17}$=I, L, V or M; $X^{19}$=any amino acid; $X^{20}$=E or D; $X^{21}$=any amino acid;

$X^{23}$=K or R; $X^{24}$=any amino acid; $X^{25}$=any amino acid; $X^{26}$=F or Y; $X^{27}$=any amino acid; $X^{29}$=any amino acid; $X^{30}$=K or R; $X^{31}$=S or G; $X^{33}$=N or K; $X^{34}$=I, L, V or M; $X^{36}$=any amino acid; $X^{38}$=K or R; $X^{39}$=any amino acid; $X^{41}$=any amino acid; $X^{42}$=any amino acid; $X^{43}$=any amino acid; $X^{46}$=F or Y; $X^{49}$=I, L, V or M; $X^{50}$=any amino acid; $X^{52}$=A, S or G; $X^{53}$=E or D; $X^{54}$=any amino acid; $X^{55}$=any amino acid; $X^{58}$=any amino acid; $X^{59}$=any amino acid; $X^{62}$=any amino acid; $X^{65}$=N or Q; $X^{67}$=any amino acid; $X^{68}$=any amino acid; $X^{69}$=any amino acid; $X^{71}$=S or T; $X^{73}$=any amino acid; $X^{74}$=I, L, V or M; $X^{76}$=any amino acid; $X^{78}$=any amino acid; and $X^{80}$=A, S or T.

These functionally-related and/or closely-related RBP45A clade polypeptides also may be identified by a consensus third RRM domain (RRM3 domain) sequence, SEQ ID NO: 846:

$X^1TX^3FVGX^7X^8DX^{10}X^{11}X^{12}X^{13}X^{14}X^{15}X^{16}LX^{18}X^{19}X^{20}FX^{22}$ $X^{23}X^{24}GX^{26}X^{27}X^{28}X^{29}VKIX_{33}X^{34}GKX^{37}CGFX^{41}QX^{43}X^{44}$ $X^{45}X^{46}X^{47}X^{48}X^{49}X^{50}X^{51}AX^{53}X^{54}X^{55}LX^{57}GX^{59}X^{60}X^{61}$ $X^{62}X^{63}X^{64}X^{65}X^{66}RLSWGRX^{73}$ where $X^1$=any amino acid; $X^3$=I, L, V or M; $X^7$=any amino acid; $X^8$=I, L, V or M; $X^{10}$=any amino acid; $X^{11}$=any amino acid; $X^{12}$=I, L, V or M; $X^{13}$=any amino acid; $X^{14}$=E or D; $X^{15}$=N, E or D; $X^{16}$=any amino acid; $X^{18}$=K or R; $X^{19}$=any amino acid; $X^{20}$=any amino acid; $X^{22}$=any amino acid; $X^{23}$=any amino acid; $X^{24}$=F or Y; $X^{26}$=E, Q or D; $X^{27}$=I, L, V or M; $X^{28}$=any amino acid; $X^{29}$=any amino acid; $X^{33}$=any amino acid; $X^{34}$=any amino acid; $X^{37}$=any amino acid; $X^{41}$=I, L, V or M; $X^{43}$=F or Y; $X^{44}$=any amino acid; $X^{45}$=any amino acid; $X^{46}$=K or R; $X^{47}$=any amino acid; $X^{48}$=S or C; $X^{49}$=A or S; $X^{50}$=E or D; $X^{51}$=any amino acid; $X^{53}$=I, L, V or M; $X^{54}$=any amino acid; $X^{55}$=any amino acid; $X^{57}$=any amino acid; $X^{59}$=any amino acid; $X^{60}$=any amino acid; $X^{61}$=I, L, V or M; $X^{62}$=S, A or G; $X^{63}$=A or G; $X^{64}$=any amino acid; $X^{65}$=any amino acid; $X^{66}$=any amino acid; and $X^{73}$=any amino acid.

TCP6 Clade Polypeptides

TABLE 7

Conserved 'TCP domain' of TCP6 and closely related sequences

| Col. 1 SEQ ID NO: | Col. 2 Species/ Identifier | Col. 3 Percent identity of polypeptide in Col. 1 to TCP6 | Col. 4 TCP domain in amino acid coordinates | Col. 5 Conserved TCP domain | Col. 6 SEQ ID NO: of TCP domain | Col. 7 Percent identity of TCP domain in Col. 5 to TCP domain of TCP6 |
|---|---|---|---|---|---|---|
| 86 | At/TCP6 or AT5G41030.1 | 100% (243/243) | 64-125 | KKKPNKDRHLKVEG RGRRVRLPPLCAARI YQLTKELGHKSDGE TLEWLLQHAEPSILS ATVN | 588 | 100% (62/62) |
| 106 | Sl/Solyc02g094290.1.1 | 76% (48/63) | 33-94 | KRKSNKDRHTKVEG RGRRIRMPALCAARI FQLTRELGHKSDGE TIQWLLQKAEPSIIA ATGH | 598 | 75% (47/62) |
| 96 | Gm/Glyma16g05840.1 | 48% (67/138) | 68-129 | KRSSNKDRHTKVEG RGRRIRMPALCAARI FQLTRELGHKSDGE TIQWLLQQAEPSIIA ATGT | 593 | 74% (46/62) |
| 84 | At/AT3G27010.1 | 41% (128/311) | 74-135 | KRSSNKDRHTKVEG RGRRIRMPALCAARI FQLTRELGHKSDGE TIQWLLQQAEPSIIA ATGS | 587 | 74% (46/62) |
| 94 | Pt/POPTR_0017s09820.1 | 37% (113/300) | 83-144 | KRSSNKDRHTKVEG RGRRIRMPALCAARI FQLTRELGHKSDGE TIQWLLQQAEPSIIA ATGT | 592 | 74% (46/62) |
| 88 | Cc/clementine0.9_016144m | 36% (114/312) | 66-127 | KRSSNKDRHTKVEG RGRRIRMPALCAARI FQLTRELGHKSDGE TIQWLLQQAEPSIIA ATGT | 589 | 74% (46/62) |
| 90 | Cc/clementine0.9_016174m | 36% (114/312) | 66-127 | KRSSNKDRHTKVEG RGRRIRMPALCAARI FQLTRELGHKSDGE | 590 | 74% (46/62) |

TABLE 7-continued

Conserved 'TCP domain' of TCP6 and closely related sequences

| Col. 1 SEQ ID NO: | Col. 2 Species/ Identifier | Col. 3 Percent identity of polypeptide in Col. 1 to TCP6 | Col. 4 TCP domain in amino acid coordinates | Col. 5 Conserved TCP domain | Col. 6 SEQ ID NO: of TCP domain | Col. 7 Percent identity of TCP domain in Col. 5 to TCP domain of TCP6 |
|---|---|---|---|---|---|---|
| | | | | TIQWLLQQAEPSIIA ATGT | | |
| 92 | Pt/POPTR_0001s33470.1 | 34% (115/332) | 78-139 | KRSSNKDRHTKVEG RGRRIRMPALCAARI FQLTRELGHKSDGE TIQWLLQQAEPSIIA ATGT | 591 | 74% (46/62) |
| 98 | Gm/Glyma19g26560.1 | 34% (100/290) | 68-129 | KRSSNKDRHTKVEG RGRRIRMPALCAARI FQLTRELGHKSDGE TIQWLLQQAEPSIIA ATGT | 594 | 74% (46/62) |
| 100 | Cc/clementine0.9_018374m | 38% (95/245) | 30-91 | KRSSNKDRHKKVDG RGRRIRMPALCAARI FQLTRELGHKSDGE TIQWLLQQAEPSIIA ATGT | 595 | 73% (45/62) |
| 104 | Pt/POPTR_0003s16630.1 | 35% (99/280) | 60-121 | KRSSNKDRHKKVEG RGRRIRIPALCAARIF QLTRELEHKSDGETI QWLLQQAEPSIIAAT GT | 597 | 72% (45/62) |
| 72 | Bd/Bradi2g59240.1 | 39% (86/220) | 84-145 | KRSSNKDRHTKVDG RGRRIRMPALCAARI FQLTRELGHKSDGE TVQWLLQQAEPAIV AATGS | 581 | 70% (44/62)) |
| 74 | Os/LOC_Os01g69980.1 | 39% (76/194) | 83-144 | KRSSNKDRHTKVDG RGRRIRMPALCAARI FQLTRELGHKSDGE TVQWLLQQAEPAIV AATGT | 582 | 70% (44/62) |
| 78 | Zm/GRMZM2G092214_T01 | 38% (85/218) | 98-159 | KRSSNKDRHTKVDG RGRRIRMPALCAARI FQLTRELGHKSDGE TVQWLLQQAEPAIV AATGT | 584 | 70% (44/62) |
| 80 | Zm/GRMZM2G092214_T02 | 38% (85/218) | 98-159 | KRSSNKDRHTKVDG RGRRIRMPALCAARI FQLTRELGHKSDGE TVQWLLQQAEPAIV AATGT | 585 | 70% (44/62)) |
| 76 | Zm/GRMZM2G034638_T01 | 37% (82/216) | 88-149 | KRSSNKDRHTKVDG RGRRIRMPALCAARI FQLTRELGHKSDGE TVQWLLQQAEPAIV AATGT | 583 | 70% (44/62) |
| 102 | Pt/POPTR_0001s13500.1 | 36% (85/236) | 60-121 | KRSSNKDRHKKVDG RGRRIRMPALCAARI FQLTRELGNKSDGE TIQWLLQQAEPSIIA ATGT | 596 | 70% (44/62) |

TABLE 7-continued

Conserved 'TCP domain' of TCP6 and closely related sequences

| Col. 1 SEQ ID NO: | Col. 2 Species/ Identifier | Col. 3 Percent identity of polypeptide in Col. 1 to TCP6 | Col. 4 TCP domain in amino acid coordinates | Col. 5 Conserved TCP domain | Col. 6 SEQ ID NO: of TCP domain | Col. 7 Percent identity of TCP domain in Col. 5 to TCP domain of TCP6 |
|---|---|---|---|---|---|---|
| 82 | Eg/Eucgr.B03529.1 | 36% (105/286) | 40-101 | KRSSNKDRHKKVDG RGRRIRMPALCAARI FQLTRELGHKTDGE TIQWLLQQAEPSIVA ATGT | 586 | 70% (44/62) |

These functionally-related and/or closely-related TCP6 clade polypeptides may be identified by a consensus TCP domain sequence, SEQ ID NO: 847:

$KX^2X^3X^4NKDRHX^{10}KVX^{13}GRGRRX^{19}RX^{21}PX^{23}LCAARIX^{30}$
$QLTX^{34}ELX^{37}X^{38}KX^{40}DGETX^{45}X^{46}WLLQX^{51}AEPX^{55}IX^{57}X^{58}$
$ATX^{61}X^{62}$ where $X^2$=K or R; $X^3$=any amino acid; $X^4$=S or P; $X^{10}$=any amino acid; $X^{13}$=D or E; $X^{19}$=I, L, V or M; $X^{21}$=I, L, V or M; $X^{23}$=A or P; $X^{30}$=F or Y; $X^{34}$=K or R; $X^{37}$=any amino acid; $X^{38}$=H or N; $X^{40}$=S or T; $X^{45}$=I, L, V or M; $X^{46}$=Q or E; $X^{51}$=H, Q or K; $X^{55}$=S or A; $X^{57}$=I, L, V or M; $X^{58}$=S or A; $X^{61}$=any amino acid; and $X^{62}$=any amino acid.

PIL1 Clade Polypeptides

TABLE 8

Conserved 'bHLH domain' of PIL1 and closely related sequences

| Col. 1 SEQ ID NO: | Col. 2 Species/ Identifier | Col. 3 Percent identity of polypeptide in Col. 1 to PIL1 | Col. 4 bHLH domain in amino acid coordinates | Col. 5 Conserved bHLH domain | Col. 6 SEQ ID NO: of bHLH domain | Col. 7 Percent identity of bHLH domain in Col. 5 to bHLH domain of PIL1 |
|---|---|---|---|---|---|---|
| 108 | At/PIL1 pr AT2G46970.1 | 100% (416/416) | 227-283 | RKRSIEVHKLYER KRRDEFNKKMRAL QDLLPNCYKDDKA SLLDEAIKYMRTLQ LQVQ | 599 | 100% (57/57) |
| 112 | Cc/clementine0.9_007946m | 41% (96/231) | 309-365 | KKRTPEVHKRYER KRRDKINKKMRAL QELIPNCNKVDKAS VLEEAIDYLKTLQF QVM | 601 | 70% (40/57) |
| 116 | Pt/POPTR_0014s10700.1 | 40% (104/254) | 379-435 | RRRATEIHNLSERK RRDRINKKMRALQ DLIPNSNKVDKAS MLGEAIDYLKSLQL QVQ | 603 | 70% (40/57) |
| 114 | Gm/Glyma10g27910.1 | 39% (104/262) | 187-243 | RSRNAEVHNLCER KRRDKINKRMRILK ELIPNCNKTDKASM LDDAIEYLKTLKLQ LQ | 602 | 63% (36/57) |
| 110 | At/AT3G62090.2 | 43% (173/399) | 186-242 | RKRNAEAYNSPER NQRNDINKKMRTL QNLLPNSHKDDNE SMLDEAINYMTNL QLQVQ | 600 | 61% (35/57) |

These functionally-related and/or closely-related PIL1 clade polypeptides may be identified by a consensus bHLH domain sequence, SEQ ID NO: 848:

$X^1X^2RX^4X^5EX^7X^8X^9X^{10}X^{11}ERX^{14}X^{15}RX^{17}X^{18}X^{19}NRX^{22}MRX^{25}$
$LX^{27}X^{28}LX^{30}PNX^{33}X^{34}RX^{36}DX^{38}X^{39}SX^{41}LX^{43}X^{44}AIX^{47}YX^{49}$
$X^{50}X^{51}LX^{53}X^{54}QX^{56}X^{57}$ where $X^1$=R or K; $X^2$=any amino acid; $X^4$=any amino acid; $X^5$=any amino acid; $X^7$=any amino acid; $X^8$=H or Y; $X^9$=N or K; $X^{10}$=any amino acid; $X^{11}$=any amino acid; $X^{14}$=N or K; $X^{15}$=any amino acid; $X^{17}$=D or N; $X^{18}$=any amino acid; $X^{19}$=F, I, L, V or M; $X^{22}$=R or K; $X^{25}$=any amino acid; $X^{27}$=Q or K; $X^{28}$=N, D or E; $X^{30}$=I, L, V or M; $X^{33}$=S or C; $X^{34}$=any amino acid; $X^{36}$=any amino acid; $X^{38}$=N or K; $X^{39}$=any amino acid; $X^{41}$=I, L, V or M; $X^{43}$=any amino acid; $X^{44}$=D or E; $X^{47}$=any amino acid; $X^{49}$=I, L, V or M; $X^{50}$=any amino acid; $X^{51}$=any amino acid; $X^{53}$=Q or K; $X^{54}$=F, I, L, V or M; $X^{56}$=I, L, V or M; and $X^{57}$=any amino acid.

PCL1 Clade Polypeptides

TABLE 9

Conserved 'SANT domain' of PCL1 and closely related sequences

| Col. 1 SEQ ID NO: | Col. 2 Species/ Identifier | Col. 3 Percent identity of polypeptide in Col. 1 to PCL1 | Col. 4 SANT domain in amino acid coordinates | Col. 5 Conserved SANT domain | Col. 6 SEQ ID NO: of SANT domain | Col. 7 Percent identity of SANT domain in Col. 5 to SANT domain of PCL1 |
|---|---|---|---|---|---|---|
| 126 | At/PCL1 or AT3G46640.3 | 100% (324/324) | 146-196 | RLVWTPQLHKRFVD VVAHLGIKNAVPKTI MQLMNVEGLTREN VASHLQKYR | 608 | 100% (51/51) |
| 128 | At/AT5G59570.1 | 63% (181/286) | 143-193 | RLVWTPQLHKRFVD VVAHLGIKNAVPKTI MQLMNVEGLTREN VASHLQKYR | 609 | 100% (51/51) |
| 148 | Gm/Glyma11g14490.1 | 62% (156/249) | 146-196 | RLVWTPQLHKRFVD VVAHLGIKNAVPKTI MQLMNVEGLTREN VASHLQKYR | 619 | 100% (51/51) |
| 150 | Gm/Glyma11g14490.2 | 62% (156/249) | 146-196 | RLVWTPQLHKRFVD VVAHLGIKNAVPKTI MQLMNVEGLTREN VASHLQKYR | 620 | 100% (51/51) |
| 152 | Gm/Glyma12g06410.1 | 60% (148/245) | 145-195 | RLVWTPQLHKRFVD VVAHLGIKNAVPKTI MQLMNVEGLTREN VASHLQKYR | 621 | 100% (51/51) |
| 144 | Sl/Solyc06g005680.2.1 | 59% (145/242) | 148-198 | RLVWTPQLHKRFVD VVAHLGIKNAVPKTI MQLMNVEGLTREN VASHLQKYR | 617 | 100% (51/51) |
| 130 | Cc/clementine0.9_013078m | 58% (146/251) | 158-208 | RLVWTPQLHKRFVD VVAHLGIKNAVPKTI MQLMNVEGLTREN VASHLQKYR | 610 | 100% (51/51) |
| 132 | Cc/clementine0.9_013095m | 58% (146/251) | 158-208 | RLVWTPQLHKRFVD VVAHLGIKNAVPKTI MQLMNVEGLTREN VASHLQKYR | 611 | 100% (51/51) |

TABLE 9-continued

Conserved 'SANT domain' of PCL1 and closely related sequences

| Col. 1 SEQ ID NO: | Col. 2 Species/ Identifier | Col. 3 Percent identity of polypeptide in Col. 1 to PCL1 | Col. 4 SANT domain in amino acid coordinates | Col. 5 Conserved SANT domain | Col. 6 SEQ ID NO: of SANT domain | Col. 7 Percent identity of SANT domain in Col. 5 to SANT domain of PCL1 |
|---|---|---|---|---|---|---|
| 134 | Cc/clementine0.9_013088m | 58% (146/251) | 158-208 | RLVWTPQLHKRFVD VVAHLGIKNAVPKTI MQLMNVEGLTREN VASHLQKYR | 612 | 100% (51/51) |
| 136 | Eg/Eucgr.B02313.1 | 53% (150/281) | 170-220 | RLVWTPQLHKRFVD VVAHLGIKNAVPKTI MQLMNVEGLTREN VASHLQKYR | 613 | 100% (51/51) |
| 124 | Si/Si002653m | 47% (137/291) | 129-179 | RLVWTPQLHKRFVD VVAHLGIKNAVPKTI MQLMNVEGLTREN VASHLQKYR | 607 | 100% (51/51) |
| 142 | Pt/POPTR_0009s03990.2 | 56% (167/297) | 133-183 | RLVWTPQLHKRFVD VVSHLGIKNAVPKTI MQLMNVEGLTREN VASHLQKYR | 616 | 98% (50/51) |
| 154 | Vv/GSVIVT01024916001 | 54% (160/291) | 233-283 | RLVWTPQLHKRFVD VVGHLGIKNAVPKTI MQLMNVEGLTREN VASHLQKYR | 622 | 98% (50/51) |
| 140 | Pt/POPTR_0009s03990.1 | 53% (170/315) | 161-211 | RLVWTPQLHKRFVD VVSHLGIKNAVPKTI MQLMNVEGLTREN VASHLQKYR | 615 | 98% (50/51) |
| 120 | Os/LOC_Os01g74020.1 | 55% (129/233) | 120-170 | RLVWTPQLHKRFVE VVAHLGMKNAVPK TIMQLMNVEGLTRE NVASHLQKYR | 605 | 96% (49/51) |
| 122 | Zm/GRMZM2G067702_T01 | 51% (118/229) | 118-168 | RLVWTPQLHKRFVD VVAHLGIKKAVPKTI MELMNVEGLTREN VASHLQKYR | 606 | 96% (49/51) |
| 146 | Sl/Solyc06g076350.2.1 | 53% (129/241) | 152-202 | RLVWTPQLHKRFIE VVAHLGIKGAVPKTI MQLMNVEGLTREN VASHLQKYR | 618 | 94% (48/51) |
| 138 | Pt/POPTR_0001s25040.1 | 50% (155/310) | 118-168 | RLVWTPQLHKRFVD VVGHLGMKNAVPK TIMQWMNVEGLTRE NVASHLQKYR | 614 | 94% (48/51) |
| 118 | Bd/Bradi2g62067.1 | 47% (142/301) | 116-166 | RMVWNPQLHKRFV DVVAHLGIKSAVPK TIMQLMNVEGLTRE NVASHLQKYR | 604 | 94% (48/51) |

These functionally-related and/or closely-related PCL1 clade polypeptides may be identified by a consensus SANT domain sequence, SEQ ID NO: 849:

$RX^{2}VWX^{5}PQLHKRFX^{13}X^{14}VVX^{17}HLGX^{21}KX^{23}AVPKTIMX^{31}X^{32}MN$

VEGLTRENVASHLQKYR where $X^2$=I, L, V, or M; $X^5$=any amino acid; $X^{13}$=I, L, V, or M; $X^{14}$=D or E; $X^{17}$=A, S or G; $X^{21}$=I, L, V, or M; $X^{23}$=any amino acid; $X^{31}$=Q or E; and $X^{32}$=any amino acid.

GTL1 Clade Polypeptides

TABLE 10

Conserved 'Trihelix domain 1' of GTL1 and closely related sequences

| Col. 1 SEQ ID NO: | Col. 2 Species/ Identifier | Col. 3 Percent identity of polypeptide in Col. 1 to GTL1 | Col. 4 Trihelix domain 1 in amino acid coordinates | Col. 5 Conserved trihelix domain 1 | Col. 6 SEQ ID NO: of trihelix domain 1 | Col. 7 Percent identity of trihelix domain 1 in Col. 5 to first trihelix domain of GTL1 |
|---|---|---|---|---|---|---|
| 168 | At/GTL1 or AT1G33240.1 | 100% (669/669) | 60-143 | GNRWPREETLALLRI<br>RSDMDSTFRDATLK<br>APLWEHVSRKLLEL<br>GYKRSSKKCKEKFE<br>NVQKYYKRTKETRG<br>GRHDGKAYKFFSQ | 629 | 100% (84/84) |
| 156 | At/GTL1 or G634 | 100% (152/152) | 60-143 | GNRWPREETLALLRI<br>RSDMDSTFRDATLK<br>APLWEHVSRKLLEL<br>GYKRSSKKCKEKFE<br>NVQKYYKRTKETRG<br>GRHDGKAYKFFSQ | 623 | 100% (84/84) |
| 158 | Bd/Bradi5g17150.1 | 72% (66/91) | 85-168 | GNRWPREETLALIRI<br>RSEMDATFRDATLK<br>GPLWEEVSRKLAEL<br>GYKRNAKKCKEKFE<br>NVHKYYKRTKEGRT<br>GRQDGKSYRFFSE | 624 | 82% (69/84) |
| 166 | Pt/POPTR_0001s45870.1 | 75% (70/93) | 104-187 | GNRWPRQETLALLQ<br>IRSEMDAAFRDATL<br>KGPLWEDVSRKLAE<br>MGYKRSAKKCKEK<br>FENVHKYYKRTKEG<br>RAGRQDGKSYRFFSQ | 628 | 80% (68/84) |
| 172 | Gm/Glyma20g30640.1 | 68% (73/107) | 63-146 | GNRWPRQETLALLR<br>IRSDMDVAFRDASV<br>KGPLWEEVSRKMAE<br>LGYHRSSKKCKEKF<br>ENVYKYHKRTKEGR<br>SGKQDGKTYRFFDQ | 631 | 77% (65/84) |
| 186 | Gm/Glyma20g30650.1 | 75% (66/87) | 66-149 | GNRWPRQETLALLK<br>IRSDMDAVFRDSSL<br>KGPLWEEVARKLSE<br>LGYHRSAKKCKEKF<br>ENVYKYHKRTKESR<br>SGKHEGKTYKFFDQ | 638 | 76% (64/84) |
| 162 | Bd/Bradi3g30457.1 | 52% (143/275) | 86-169 | GNRWPRQETLVLLK<br>IRSDMDAAFRDATL<br>KGPLWEEVSRKLAE<br>EGYRRNAKKCKEKF<br>ENVHKYYKRTKDSR<br>AGRNDGKTYRFFQQ | 626 | 76% (64/84) |
| 164 | Si/Si034382m | 63% (74/116) | 74-157 | GNRWPRQETLALLK<br>IRSEMDAAFREAAL | 627 | 75% (63/84) |

TABLE 10-continued Conserved 'Trihelix domain 1' of GTL1 and closely related sequences

| Col. 1 SEQ ID NO: | Col. 2 Species/ Identifier | Col. 3 Percent identity of polypeptide in Col. 1 to GTL1 | Col. 4 Trihelix domain 1 in amino acid coordinates | Col. 5 Conserved trihelix domain 1 | Col. 6 SEQ ID NO: of trihelix domain 1 | Col. 7 Percent identity of trihelix domain 1 in Col. 5 to first trihelix domain of GTL1 |
|---|---|---|---|---|---|---|
| | | | | KGPLWEQVSRKLEA MGYKRSAKKCREKF ENVDKYYKRTKDG RAGRGDGKAYRFFSE | | |
| 160 | Zm/GRMZM2G169580_T01 | 58% (80/136) | 98-181 | GNRWPREETLALIRI RTEMDADFRNAPLK APLWEDVARKLAGL GYHRSAKKCKEKFE NVHKYYKRTKDAH AGRQDGKSYRFFSQ | 625 | 75% (63/84) |
| 188 | Pt/POPTR_0002s06900.1 | 71% (68/95) | 58-141 | ANRWPRQETLALLK IRSDMDAVFRDSGL KGPLWEEVSRKLAE LGYHRSAKKCKEKF ENVYKYHKRTKEGR TGKSEGKSYKFFDE | 639 | 73% (62/84) |
| 184 | Gm/Glyma16g28240.1 | 41% (108/260) | 53-136 | GNRWPRQETLALLK IRSDMDTVFRDSSLK GPLWEEVSRKLAEL GYQRSAKKCKEKFE NVYKYNKRTKDNK SGKSHGKTYKFFDQ | 637 | 73% (62/84) |
| 190 | Pt/POPTR_0005s21420.1 | 72% (63/87) | 61-144 | ANRWPRQETLALLK IRSAMDAVFRDSSL KGPLWEEVSRKLAE LGYHRSAKKCKEKF ENLYKYHKRTKEGR TGKSEGKTYKFFDE | 640 | 71% (60/84) |
| 178 | Pt/POPTR_0001s31660.1 | 70% (64/91) | 40-123 | GNRWPKQETLALLK IRSDMDVAFKDSGL KAPLWEEVSKKLNE LGYNRSAKKCKEKF ENIYKYHRRTKEGR SGRPNGKTYRFFEQ | 634 | 71% (60/84) |
| 170 | Pt/POPTR_0005s21410.1 | 44% (117/262) | 64-147 | GSRWPRQETLALLKI RSGMDVAFRDASVK GPLWEEVSRKLAEL GYNRSGKKCKEKFE NVYKYHKRTKDGR TGKQEGKTYRFFDQ | 630 | 71% (60/84) |
| 176 | Sl/Solyc12g056510.1.1 | 40% (212/519) | 70-153 | GNRWPRQETLALLK IRSEMDVVFKDSSLK GPLWEEVSRKLAEL GYHRSAKKCKEKFE NVYKYHRRTKDGR ASKADGKTYRFFDQ | 633 | 70% (59/84) |
| 180 | Pt/POPTR_0019s02650.1 | 69% (64/92) | 40-123 | ANRWPKQETLALLE IRSDMDVAFRDSVV KAPLWEEVSRKLNE LGYNRSAKKCKEKF ENIYKYHRRTKGSQ SGRPNGKTYRFFEQ | 635 | 69% (58/84) |
| 174 | Sl/Solyc04g071360.2.1 | 42% (74/175) | 58-141 | GNRWPRQETIALLKI RSEMDVIFRDSSLKG PLWEEVSRKMADLG FHRSSKKCKEKFEN VYKYHKRTKDGRA SKADGKNYRFFEQ | 632 | 69% (58/84) |

TABLE 10-continued

Conserved 'Trihelix domain 1' of GTL1 and closely related sequences

| Col. 1 SEQ ID NO: | Col. 2 Species/ Identifier | Col. 3 Percent identity of polypeptide in Col. 1 to GTL1 | Col. 4 Trihelix domain 1 in amino acid coordinates | Col. 5 Conserved trihelix domain 1 | Col. 6 SEQ ID NO: of trihelix domain 1 | Col. 7 Percent identity of trihelix domain 1 in Col. 5 to first trihelix domain of GTL1 |
|---|---|---|---|---|---|---|
| 182 | Sl/Solyc11g005380.1.1 | 69% (64/92) | 52-135 | GNRWPHEETLALLK IRSEMDVAFRDSNL KSPLWDEISRKMAE LGYNRNAKKCREKF ENIYKYHKRTKDGR SGRQTGKNYRFFEQ | 636 | 66% (56/84) |

TABLE 11

Conserved 'Trihelix domain 2' of GTL1 and closely related sequences

| Col. 1 SEQ ID NO: | Col. 2 Species/ Identifier | Col. 3 Percent identity of polypeptide in Col. 1 to GTL1 | Col. 4 Trihelix domain 2 in amino acid coordinates | Col. 5 Conserved trihelix domain 2 | Col. 6 SEQ ID NO: of trihelix domain 2 | Col. 7 Percent identity of trihelix domain 2 in Col. 5 to second trihelix domain of GTL1 |
|---|---|---|---|---|---|---|
| 168 | At/GTL1 or AT1G33240.1 | 100% (669/669) | 433-517 | SSRWPKAEILALINL RSGMEPRYQDNVPK GLLWEEISTSMKRM GYNRNAKRCKEKW ENINKYYKKVKESN KKRPQDAKTCPYFHR | 647 | 100% (85/85) |
| 156 | At/GTL1 or G634 | 100% (152/152) | 187-259 | SSRWPKAEILALINL RSGMEPRYQDNVPK GLLWEEISTSMKRM GYNRNAKRCKEKW ENINKYYKKVKESN NSN | 641 | 82% (70/85) |
| 166 | Pt/POPTR_0001s45870.1 | 75% (70/93) | 520-604 | SSRWPKPEVLALIKL RSGLETRYQEAGPK GPLWEEISAGMLRL GYKRSSKRCKEKWE NINKYFKKVKESNK KRTEDAKTCPYFHE | 646 | 76% (65/85) |
| 172 | Gm/Glyma20g30640.1 | 68% (73/107) | 457-541 | SSRWPKVEVQALIK LRTSMDEKYQENGP KGPLWEEISASMKK LGYNRNAKRCKEK WENINKYFKKVKES NKRRPEDSKTCPYF HQ | 649 | 76% (65/85) |
| 174 | Sl/Solyc04g071360.2.1 | 42% (74/175) | 459-543 | SSRWPKAEVEALIKL RTNLDVKYQENGPK GPLWEEISSGMKKIG YNRNAKRCKEKWE NINKYFKKVKESNK KRPEDSKTCPYFHQ | 650 | 76% (65/85) |
| 158 | Bd/Bradi5g17150.1 | 72% (66/91) | 496-580 | SSRWPKTEVHALIQL RMDMDNRYQENGP KGPLWEEISSGMRR LGYNRNPKRCKEK WENINKYFKKVKES | 642 | 75% (64/85) |

TABLE 11-continued

Conserved 'Trihelix domain 2' of GTL1 and closely related sequences

| Col. 1 SEQ ID NO: | Col. 2 Species/ Identifier | Col. 3 Percent identity of polypeptide in Col. 1 to GTL1 | Col. 4 Trihelix domain 2 in amino acid coordinates | Col. 5 Conserved trihelix domain 2 | Col. 6 SEQ ID NO: of trihelix domain 2 | Col. 7 Percent identity of trihelix domain 2 in Col. 5 to second trihelix domain of GTL1 |
|---|---|---|---|---|---|---|
| 162 | Bd/Bradi3g30457.1 | 52% (143/275) | 453-537 | SSRWPKAEVHALIQ LRSNLDTRYQEAGP KGPLWEEISAGMRR MGYSRSSKRCKEK WENINKYFKKVKES NKRRPEDSKTCPYF HQ | 644 | 75% (64/85) |
| 176 | Sl/Solyc12g056510.1.1 | 40% (212/519) | 455-539 | SSRWPKEEIEALISLR TCLDLKYQENGPKG PLWEEISSGMRKIGY NRNAKRCKEKWENI NKYFKKVKESNKKR PEDSKTCPYFHQ | 651 | 75% (64/85) |
| 164 | Si/Si034382m | 63% (74/116) | 458-542 | PSRWPKAEVHALIQ LRTELEARYQDSGP KGPLWEDISAGMRR LGYNRSAKRCKEK WENINKYFKKVKES NKKRPEDSKTCPYY HQ | 645 | 74% (63/85) |
| 188 | Pt/POPTR_0002s06900.1 | 71% (68/95) | 405-489 | SSRWPKEVQALIN LRANLDVKYQENG AKGPLWEDISAGMQ KLGYNRSAKRCKEK WENINKYFKKVKES NKKRPEDSKTCPYF DQ | 657 | 70% (60/85) |
| 182 | Sl/Solyc11g005380.1.1 | 69% (64/92) | 363-448 | SSRWPKAEVEALIKL RTNVDLQYQDNGSS KGPLWEDISCGMKK LGYDRNAKRCKEK WENINKYYRRVKES QKKRPEDSKTCPYF HQ | 654 | 70% (61/86) |
| 180 | Pt/POPTR_0019s02650.1 | 69% (64/92) | 331-415 | SSRWPKEEIESLIKIR TYLEFQYQENGPKG PLWEEISTSMKNLG YDRSAKRCKEKWE NMNKYFKRVKDSN KKRPGDSKTCPYFQQ | 653 | 70% (60/85) |
| 170 | Pt/POPTR_0005s21410.1 | 44% (117/262) | 404-488 | PSRWPKVEVEALIRI RTNLDCKYQDNGPK GPLWEEISARMRKL GYNRNAKRCKEKW ENINKYFKKVKESK KKRPEDSKTCPYFQQ | 648 | 70% (60/85) |
| 186 | Gm/Glyma20g30650.1 | 75% (66/87) | 442-526 | SSRWPKTEVHALIRL RTSLEAKYQENGPK APFWEDISAGMLRL GYNRSAKRCKEKW ENINKYFKKVKESN KQRREDSKTCPYFHE | 656 | 69% (59/85) |
| 178 | Pt/POPTR_0001s31660.1 | 70% (64/91) | 337-421 | PSRWPKEEIEALIGL RTKLEFQYEENGPK GPLWEEISASMKKL GYDRSAKRCKEKW | 652 | 69% (59/85) |

TABLE 11-continued

Conserved 'Trihelix domain 2' of GTL1 and closely related sequences

| Col. 1 SEQ ID NO: | Col. 2 Species/ Identifier | Col. 3 Percent identity of polypeptide in Col. 1 to GTL1 | Col. 4 Trihelix domain 2 in amino acid coordinates | Col. 5 Conserved trihelix domain 2 | Col. 6 SEQ ID NO: of trihelix domain 2 | Col. 7 Percent identity of trihelix domain 2 in Col. 5 to second trihelix domain of GTL1 |
|---|---|---|---|---|---|---|
| | | | | ENMNKYFKRVKESN KRRPGDSKTCPYFQQ | | |
| 160 | Zm/GRMZM2G169580_T01 | 58% (80/136) | 411-495 | SSRWPKEEVEALIQV RNEKDEQYHDAGG KGPLWEDIAAGMRR IGYNRSAKRCKEKW ENINKYYKKVKESN KRRPEDSKTCPYFHQ | 643 | 68% (58/85) |
| 190 | Pt/POPTR_0005s21420.1 | 72% (63/87) | 406-490 | SSRWPKVEVQALISL RADLDIKYQEHGAK GPLWEDISAGMQKL GYNRSAKRCKEKW ENINKYFKKVKESN RKRPGDSKTCPYFDQ | 658 | 67% (57/85) |
| 184 | Gm/Glyma16g28240.1 | 41% (108/260) | 412-496 | SSRWPKAEVHALIRI RTSLETKYQENGPK APLWEDISIAMQRL GYNRSAKRCKEKW ENINKYFKRVRESSK ERREDSKTCPYFHE | 655 | 67% (57/85) |

These functionally-related and/or closely-related GTL1 clade polypeptides may be identified by a consensus first Trihelix domain sequence (Trihelix 1), SEQ ID NO: 850:

$X^1X^2RWPX^6X^7ETX^{10}X^{11}LX^{13}X^{14}IRX^{17}X^{18}MDX^{21}X^{22}FX^{24}X^{25}$ $X^{26}X^{27}X^{28}KX^{30}PLWX^{34}X^{35}X^{36}X^{37}X^{38}KX^{40}X^{41}X^{42}X^{43}GX^{45}$ $X^{46}RX^{48}X^{49}KKCX^{53}EKFENX^{59}X^{60}KYX^{63}X^{64}RTKX^{68}X^{69}X^{70}X^{71}$ $X^{72}X^{73}X^{74}X^{75}GKX^{78}YX^{80}FFX^{83}X^{84}$ where $X^1$=A or G; $X^2$=any amino acid; $X^6$=any amino acid; $X^7$=Q or E; $X^{10}$=I, L, V or M; $X^{11}$=any amino acid; $X^{13}$=I, L, V or M; $X^{14}$=any amino acid; $X^{17}$=S or T; $X^{18}$=any amino acid; $X^{21}$=any amino acid; $X^{22}$=any amino acid; $X^{24}$=R or K; $X^{25}$=N, D or E; $X^{26}$=A or S; $X^{27}$=any amino acid; $X^{28}$=I, L, V or M; $X^{30}$=A, S or G; $X^{34}$=D or E; $X^{35}$=any amino acid; $X^{36}$=I, L, V or M; $X^{37}$=A or S; $X^{38}$=R or K; $X^{40}$=I, L, V or M; $X^{41}$=any amino acid; $X^{42}$=any amino acid; $X^{43}$=any amino acid; $X^{45}$=F or Y; $X^{46}$=H, Q, N, R or K; $X^{48}$=any amino acid; $X^{49}$=A, S or G; $X^{53}$=K or R; $X^{59}$=I, L, V or M; $X^{60}$=any amino acid; $X^{63}$=any amino acid; $X^{64}$=K or R; $X^{68}$=any amino acid; $X^{69}$=any amino acid; $X^{70}$=H, Q, K or, R; $X^{71}$=any amino acid; $X^{72}$=S or G; $X^{73}$=R or K; $X^{74}$=any amino acid; $X^{75}$=any amino acid; $X^{78}$=any amino acid; $X^{80}$=R or K; $X^{83}$=any amino acid; and $X^{84}$=Q or E.

These functionally-related and/or closely-related GTL1 clade polypeptides may also be identified by a consensus first Trihelix domain sequence (Trihelix 2), SEQ ID NO: 851:

$X^1SRWPKX^7EX^9X^{10}X^{11}LIX^{14}X^{15}X^{17}X^{18}X^{19}X^{20}X^{21}X^{22}YX^{24}$ $X^{25}X^{26}X^{27}X^{28}X^{29}KX^{31}X^{32}X^{33}WEX^{36}IX^{38}X^{39}X^{40}MX^{42}X^{43}X^{44}$ $GYX^{47}RX^{49}X^{50}KRCKEKWENX^{60}NKYX^{64}X^{65}X^{66}VX^{68}X^{69}SX^{71}X^{72}$ $X^{73}X^{74}X^{75}X^{76}X^{77}X^{78}X^{79}X^{80}X^{81}X^{82}X^{83}X^{84}X^{85}X^{86}$ where $X^1$=S or P; $X^7$=any amino acid; $X^9$=I, L, V or M; $X^{10}$=any amino acid; $X^{11}$=A or S; $X^{14}$=any amino acid; $X^{15}$=I, L, V or M; $X^{17}$=any amino acid; $X^{18}$=any amino acid; $X^{19}$=any amino acid; $X^{20}$=E or D; $X^{21}$=any amino acid; $X^{22}$=K, Q or R; $X^{24}$=any amino acid; $X^{25}$=E or D; $X^{26}$=any amino acid; $X^{27}$=any amino acid; $X^{28}$=S or absent; $X^{29}$=any amino acid; $X^{31}$=A or G; $X^{32}$=any amino acid; $X^{33}$=F or L; $X^{36}$=E or D; $X^{38}$=A or S; $X^{39}$=any amino acid; $X^{40}$=any amino acid; $X^{42}$=any amino acid; $X^{43}$=N, K or R; $X^{44}$=L, V or M; $X^{47}$=any amino acid; $X^{49}$=any amino acid; $X^{50}$=A, S or P; $X^{60}$=I, L, V or M; $X^{64}$=F or Y; $X^{65}$=K or R; $X^{66}$=K or R; $X^{68}$=K or R; $X^{69}$=E or D; $X^{71}$=any amino acid; $X^{72}$=N, K or R; $X^{73}$=any amino acid; $X^{74}$=N or R; $X^{75}$=any amino acid or absent; $X^{76}$=any amino acid or absent; $X^{77}$=D or absent; $X^{78}$=S, A or absent; $X^{79}$=K or absent; $X^{80}$=T or absent; $X^{81}$=C or absent; $X^{82}$=P or absent; $X^{83}$=Y or absent; $X^{84}$=F, Y or absent; $X^{85}$=H, Q, D or absent; $X^{86}$=any amino acid or absent.

DREB2H Clade Polypeptides

TABLE 12

Conserved 'AP2 domain' of DREB2H and closely related sequences

| Col. 1 SEQ ID NO: | Col. 2 Species/ Identifier | Col. 3 Percent identity of polypeptide in Col. 1 to DREB2H | Col. 4 AP2 domain in amino acid coordinates | Col. 5 Conserved AP2 domain | Col. 6 SEQ ID NO: of AP2 domain | Col. 7 Percent identity of AP2 domain in Col. 5 to AP2 domain of DREB2H |
|---|---|---|---|---|---|---|
| 218 | At/DREB2H or AT2G40350.1 | 100% (157/157) | 65-122 | CDYTGVRQRTWGK WVAEIREPGRGAKL WLGTFSSSYEAALA YDEASKAIYGQSAR LNL | 672 | 100% (58/58) |
| 192 | At/G1755 | 100% (155/155) | 72-129 | CDYTGVRQRTWGK WVAEIREPGRGAKL WLGTFSSSYEAALA YDEASKAIYGQSAR LNL | 659 | 100% (58/58) |
| 216 | At/AT2G40340.1 | 86% (108/125) | 70-127 | CDYRGVRQRRWGK WVAEIREPDGGARL WLGTFSSSYEAALA YDEAAKAIYGQSAR LNL | 671 | 89% (52/58) |
| 232 | Sl/Solyc05g052410.1.1 | 65% (82/125) | 72-129 | CKYRGVRQRTWGK WVAEIREPHRGRRL WLGTFDTAIEAALA YDEAARAMYGPCA RLNL | 679 | 75% (44/58) |
| 230 | Pt/POPTR_0010s19100.1 | 65% (79/121) | 78-135 | CNYRGVRQRTWGK WVAEIREPNRGPRL WLGTFPTAYEAALA YDEAARAMYGPYA RLNV | 678 | 75% (44/58) |
| 226 | Gm/Glyma14g06080.1 | 64% (80/125) | 78-135 | CNYRGVRQRTWGK WVGEIREPNRGSRL WLGTFSSAQEAALA YDEAARAMYGPCA RLNF | 676 | 75% (44/58) |
| 224 | Gm/Glyma02g42960.1 | 62% (79/127) | 78-135 | CNYRGVRQRTWGK WVGEIREPNRGSRL WLGTFSSAQEAALA YDEAARAMYGPCA RLNF | 675 | 75% (44/58) |
| 228 | Pt/POPTR_0008s07360.1 | 65% (79/121) | 78-135 | CNYRGVRQRTWGK WVAEIREPNRGPRL WLGTFPTAYEAALA YDNAARAMYGSCA RLNI | 677 | 74% (43/58) |
| 234 | Sl/Solyc06g050520.1.1 | 63% (79/125) | 80-137 | CKYRGVRQRIWGK WVAEIREPKRGSRL WLGTFGTAIEAALA YDDAARAMYGPCA RLNL | 680 | 72% (42/58) |
| 214 | Gm/Glyma13g38030.1 | 61% (76/123) | 63-120 | CNYRGVRQRTWGK WVAEIREPNRGNRL WLGTFPTAIGAALA YDEAARAMYGSCA RLNF | 670 | 72% (42/58) |
| 208 | Gm/Glyma06g45680.1 | 61% (72/118) | 65-122 | CNYRGVRQRTWGK WVAEIREPNRGSRL WLGTFPTAISAALA YDEAARAMYGSCA RLNF | 667 | 72% (42/58) |

TABLE 12-continued

Conserved 'AP2 domain' of DREB2H and closely related sequences

| Col. 1 SEQ ID NO: | Col. 2 Species/ Identifier | Col. 3 Percent identity of polypeptide in Col. 1 to DREB2H | Col. 4 AP2 domain in amino acid coordinates | Col. 5 Conserved AP2 domain | Col. 6 SEQ ID NO: of AP2 domain | Col. 7 Percent identity of AP2 domain in Col. 5 to AP2 domain of DREB2H |
|---|---|---|---|---|---|---|
| 212 | Gm/Glyma12g32400.1 | 60% (75/123) | 63-120 | CNYRGVRQRTWGK WVAEIREPNRGNRL WLGTFPTAIGAALA YDEAARAMYGSCA RLNF | 669 | 72% (42/58) |
| 210 | Gm/Glyma12g11150.1 | 60% (72/119) | 65-122 | CNYRGVRQRTWGK WVAEIREPNRGSRL WLGTFPTAISAALA YDEAAMAMYGFCA RLNF | 668 | 72% (42/58) |
| 206 | Eg/Eucgr.G03094.1 | 61% (74/121) | 69-126 | FNYRGVRQRTWGK WVAEIREPNRGSRL WLGTFPTAIEAAKA YDEAATAMYGPCA RLNF | 666 | 70% (41/58) |
| 198 | Si/Si002067m | 60% (72/120) | 167-224 | CPYRGVRQRTWGK WVAEIREPNRGKRL WLGSFPTAVEAAHA YDEAAKAMYGPKA RVNF | 662 | 70 (41/58) |
| 194 | Bd/Bradi2g04000.1 | 56% (67/119) | 76-133 | CAYRGVRQRTWGK WVAEIREPNRGKRL WLGSFPTAVEAAHA YDEAARAMYGAKA RVNF | 660 | 68% (40/58) |
| 196 | Os/LOC_Os01g07120.1 | 55% (66/119) | 81-138 | CAYRGVRQRTWGK WVAEIREPNRGRRL WLGSFPTALEAAHA YDEAARAMYGPTA RVNF | 661 | 68% (40/58) |
| 202 | Si/Si022619m | 58% (73/125) | 83-140 | CGYRGVRQRTWGK WVAEIREPNRANRL WLGTFPTAEDAARA YDQAARAMYGEVA RTNF | 664 | 65% (38/58) |
| 204 | Si/Si022621m | 58% (73/125) | 82-139 | CGYRGVRQRTWGK WVAEIREPNRANRL WLGTFPTAEDAARA YDQAARAMYGEVA RTNF | 665 | 65% (38/58) |
| 200 | Bd/Bradi2g29960.1 | 56% (70/123) | 130-187 | CKFRGVRQRTWGK WVAEIREPNRVSRL WLGTFPTAETAACA YDEAARAMYGPLA RTNF | 663 | 65% (38/58) |
| 220 | Gm/Glyma07g19220.1 | 57% (73/128) | 65-129 | CKFRGVRQRIWGK WVAEIREPINGKLV GEKANRLWLGTFST ALEAALAYDEAAKA MYGPCARLNF | 673 | 63% (41/65) |
| 222 | Gm/Glyma18g43750.1 | 57% (73/127) | 65-129 | CKFRGVRQRIWGK WVAEIREPINGKLV GEKANRLWLGTFST ALEAALAYDEAAKA LYGPCARLNF | 674 | 63% (41/65) |

These functionally-related and/or closely-related DREB2H clade polypeptides may be identified by a consensus AP2 domain sequence, SEQ ID NO: 852:

$X^1X^2X^3GVRQRX^9WGKWVX^{15}EIREPX^{21}X^{22}X^{23}X^{24}X^{25}X^{26}X^{27}$ $X^{28}X^{29}X^{30}X^{31}X^{32}LWLGX^{37}FX^{39}X^{40}X^{41}X^{42}X^{43}AAX^{46}AYDX^{50}$ $AX^{52}X^{53}AX^{55}YGX^{58}X^{59}ARX^{62}NX^{64}$ where $X^1$=any amino acid; $X^2$=F or Y; $X^3$=any amino acid; $X^9$=any amino acid; $X^{15}$=A or G; $X^{21}$=I or absent; $X^{22}$=N or absent; $X^{23}$=G or absent; $X^{24}$=K or absent; $X^{25}$=L or absent; $X^{26}$=V or absent; $X^{27}$=G or absent; $X^{28}$=any amino acid; $X^{29}$=any amino acid; $X^{30}$=any amino acid; $X^{31}$=any amino acid; $X^{32}$=R or K; $X^{37}$=S or T; $X^{39}$=any amino acid; $X^{40}$=S or T; $X^{41}$=A or S; $X^{42}$=any amino acid; $X^{43}$=any amino acid; $X^{46}$=any amino acid; $X^{50}$=Q, D, N or E; $X^{52}$=A or S; $X^{53}$=any amino acid; $X^{55}$=I, L, V or M; $X^{58}$=any amino acid; $X^{59}$=any amino acid; $X^{62}$=any amino acid; and $X^{64}$=F, I, L, V or M ERF087 Clade Polypeptides

TABLE 13

Conserved 'AP2 domain' of ERF087 and closely related sequences

| Col. 1 SEQ ID NO: | Col. 2 Species/ Identifier | Col. 3 Percent identity of polypeptide in Col. 1 to ERF087 | Col. 4 AP2 domain in amino acid coordinates | Col. 5 Conserved AP2 domain | Col. 6 SEQ ID NO: of AP2 domain | Col. 7 Percent identity of AP2 domain in Col. 5 to AP2 domain of ERF087 |
|---|---|---|---|---|---|---|
| 246 | At/ERF087 or AT1G28160.1 | 100% (245/245) | 38-101 | KYVGVRRRPWGRY AAEIRNPTTKERYW LGTFDTAEEAALAY DRAARSIRGLTART NFVYSDMPR | 686 | 100% (64/64) |
| 254 | At/AT5G13910.1 | 83% (64/77) | 19-82 | RFLGVRRRPWGRYA AEIRDPTTKERHWL GTFDTAEEAALAYD RAARSMRGTRARTN FVYSDMPP | 690 | 85% (55/64) |
| 248 | Eg/Eucgr.B03565.1 | 47% (104/221) | 46-109 | RFLGVRRRPWGRYA AEIRDPTTKERHWL GTFDTAEEAALAYD RAARSMRGAKART NFVYSDMPP | 687 | 85% (55/64) |
| 266 | Vv/GSVIVT01032961001 | 84% (65/77) | 21-84 | RFLGVRRRPWGRYA AEIRDPSTKERHWL GTFDTAEEAALAYD RAARSMRGSRARTN FVYSDMPP | 696 | 84% (54/64) |
| 256 | Pt/POPTR_0001s15710.1 | 81% (64/79) | 25-88 | RFLGVRRRPWGRYA AEIRDPSTKERHWL GTFDTAEEAALAYD RAARSMRGSRARTN FVYSDMPA | 691 | 84% (54/64) |
| 258 | Pt/POPTR_0003s07540.1 | 81% (64/79) | 25-88 | RFLGVRRRPWGRYA AEIRDPSTKERHWL GTFDTAEEAALAYD RAARSMRGPRARTN FVYSDMPA | 692 | 84% (54/64) |
| 252 | Pt/POPTR_0003s15940.1 | 70% (84/120) | 39-102 | RFLGVRRRPWGRYA AEIRDPSTKERHWL GTFDTAEEAALAYD RAARSMRGSKARTN FVYSDMPP | 689 | 84% (54/64) |
| 250 | Pt/POPTR_0001s12820.1 | 45% (109/240) | 37-100 | RFLGVRRRPWGRYA AEIRDPSTKERHWL GTFDTAEEAALAYD RAARSMRGSKARTN FVYSDMPP | 688 | 84% (54/64) |
| 262 | Gm/Glyma02g07460.1 | 72% (69/95) | 31-94 | RYLGVRRRPWGRY AAEIRDPSTKERHW LGTFDTAEEAALAY DRAARSMRGSRART NFVYPDTPP | 694 | 82% (53/64) |

TABLE 13-continued

Conserved 'AP2 domain' of ERF087 and closely related sequences

| Col. 1 SEQ ID NO: | Col. 2 Species/ Identifier | Col. 3 Percent identity of polypeptide in Col. 1 to ERF087 | Col. 4 AP2 domain in amino acid coordinates | Col. 5 Conserved AP2 domain | Col. 6 SEQ ID NO: of AP2 domain | Col. 7 Percent identity of AP2 domain in Col. 5 to AP2 domain of ERF087 |
|---|---|---|---|---|---|---|
| 260 | Eg/Eucgr.I01576.1 | 51% (81/157) | 27-90 | RFLGVRRRPWGRYA AEIRDPSTKERHWL GTFDTAEEAALAYD RAARSMRGSRARTN FVYSDLPA | 693 | 82% (53/64) |
| 238 | Os/LOC_Os02g32040.1 | 75% (60/79) | 39-102 | RYLGVRRRPWGRY AAEIRDPATKERHW LGTFDTAEEAAVAY DRAARTIRGAAART NFAYPDLPP | 682 | 79% (51/64) |
| 264 | Gm/Glyma16g26460.1 | 70% (67/95) | 31-94 | RYLGVRRRPWGRY AAEIRDPSTKERHW LGTFDTAEEAALAY DKAARSMRGSRART NFIYPDTPP | 695 | 79% (51/64) |
| 240 | Os/LOC_Os04g32790.1 | 69% (62/89) | 51-114 | RYLGVRRRPWGRY AAEIRDPATKERHW LGTFDTAEEAAVAY DRAARSLRGARART NFAYPDLPP | 683 | 79% (51/64) |
| 242 | Zm/GRMZM2G023708_T01 | 69% (62/89) | 41-104 | RYLGVRRRPWGRY AAEIRDPATKERHW LGTFDTAEEAAVAY DRAARSLRGARART NFAYPDLPP | 684 | 79% (51/64) |
| 236 | Zm/GRMZM2G047999_T01 | 64% (73/114) | 73-136 | RYLGVRRRPWGRY AAEIRDPATKERHW LGTFDTAEEAAIAY DRAARNIRGANART NFAYPDLPP | 681 | 79% (51/64) |
| 244 | Zm/GRMZM2G079825_T01 | 63% (73/115) | 37-100 | RYLGVRRRPWGRY AAEIRDPATKERHW LGTFDTAEEAAVAY DRAARSLRGARART NFAYPDLPP | 685 | 79% (51/64) |
| 268 | Gm/Glyma16g05070.1 | 49% (74/150) | 14-77 | RYLGVRRRPWGRY AAEIRDPSTKERHW LGTFDTADEAALAY DRAARAMRGSRAR TNFVYADTTP | 697 | 78% (50/64) |

These functionally-related and/or closely-related ERF087 clade polypeptides may be identified by a consensus AP2 domain sequence, SEQ ID NO: 853:

$X^1X^2X^3$GVRRRPWGRYAAEIRX$^{19}$PX$^{21}$TKERX$^{26}$WLGTFDTAX$^{35}$
EAAX$^{39}$AYDX$^{43}$AARX$^{47}$X$^{48}$RGX$^{51}$X$^{52}$ARTNFX$^{58}$YX$^{60}$DX$^{62}$X$^{63}$
X$^{64}$ where $X^1$=K or R; $X^2$=F or Y; $X^3$=I, L, V or M; $X^{19}$=N or D; $X^{21}$=A, S or T; $X^{26}$=H or Y; $X^{35}$=D or E; $X^{39}$=I, L, V or M; $X^{43}$=R or K; $X^{47}$=any amino acid; $X^{48}$=I, L, V or M; $X^{51}$=any amino acid; $X^{52}$=any amino acid; $X^{58}$=any amino acid; $X^{60}$=S, A or P; $X^{62}$=any amino acid; $X^{63}$=T or P; and $X^{64}$=any amino acid.

BBX18 Clade Polypeptides

TABLE 14

Conserved first 'BBX domain' of BBX18 and closely related sequences

| Col. 1 SEQ ID NO: | Col. 2 Species/ Identifier | Col. 3 Percent identity of polypeptide in Col. 1 to BBX18 | Col. 4 BBX domain 1 in amino acid coordinates | Col. 5 Conserved BBX domain 1 | Col. 6 SEQ ID NO: of BBX domain 1 | Col. 7 Percent identity of first BBX domain in Col. 5 to first BBX domain of BBX18 |
|---|---|---|---|---|---|---|
| 278 | At/BBX18 or AT2G21320.1 | 100% (172/172) | 5-42 | CDACESAAAIVFCA ADEAALCCSCDEKV HKCNKLASRH | 702 | 100% (38/38) |
| 290 | Pt/POPTR_0007s13830.1 | 61% (114/184) | 5-42 | CDACESAAAIVFCA ADEAALCLACDEKV HMCNKLASRH | 708 | 92% (35/38) |
| 284 | Gm/Glyma01g37370.1 | 60% (111/183) | 5-42 | CDACESAAAIVFCA ADEAALCRACDEKV HMCNKLASRH | 705 | 92% (35/38) |
| 286 | Gm/Glyma11g07930.1 | 59% (112/189) | 5-42 | CDACESAAAIVFCA ADEAALCRACDEKV HMCNKLASRH | 706 | 92% (35/38) |
| 296 | Pt/POPTR_0004s16950.1 | 60% (111/184) | 5-42 | CDVCESAAAILFCA ADEAALCRSCDEKV HMCNKLASRH | 711 | 89% (34/38) |
| 298 | Pt/POPTR_0009s12730.1 | 60% (111/184) | 5-42 | CDVCESAAAILFCA ADEAALCRSCDEKV HLCNKLASRH | 712 | 89% (34/38) |
| 300 | Vv/GSVIVT01024173001 | 59% (117/198) | 5-42 | CDACESAAAILFCA ADEAALCRACDEKV HMCNKLASRH | 713 | 89% (34/38) |
| 302 | Sl/Solyc01g110370.2.1 | 58% (114/196) | 5-42 | CDVCESAAAILFCA ADEAALCRSCDEKV HLCNKLASRH | 714 | 89% (34/38) |
| 280 | At/AT4G38960.1 | 76% (131/171) | 5-42 | CDACENAAAIIFCAA DEAALCRPCDEKVH MCNKLASRH | 703 | 86% (33/38) |
| 288 | Pt/POPTR_0005s11900.1 | 61% (114/184) | 5-42 | CDACESAFAIVFCAA DEAALCLACDKKVH MCNKLASRH | 707 | 86% (33/38) |
| 292 | Vv/GSVIVT01018818001 | 60% (110/183) | 5-42 | CDVCESAAAILFCA ADEAALCRVCDEKV HMCNKLASRH | 709 | 86% (33/38) |
| 282 | Eg/Eucgr.I02368.1 | 57% (107/185) | 5-42 | CDACESAAAVVFCA ADEAALCSACDDKV HMCNKLASRH | 704 | 86% (33/38) |
| 306 | Gm/Glyma12g04130.1 | 63% (110/172) | 5-42 | CDVCESAAAIVFCA ADEAALCSACDHKI HMCNKLASRH | 716 | 84% (32/38) |
| 294 | Eg/Eucgr.I01328.1 | 57% (111/193) | 5-42 | CDVCENAAAIFFCA ADEAALCRACDEKV HLCNKLASRH | 710 | 84% (32/38) |

TABLE 14-continued

Conserved first 'BBX domain' of BBX18 and closely related sequences

| Col. 1 SEQ ID NO: | Col. 2 Species/ Identifier | Col. 3 Percent identity of polypeptide in Col. 1 to BBX18 | Col. 4 BBX domain 1 in amino acid coordinates | Col. 5 Conserved BBX domain 1 | Col. 6 SEQ ID NO: of BBX domain 1 | Col. 7 Percent identity of first BBX domain in Col. 5 to first BBX domain of BBX18 |
|---|---|---|---|---|---|---|
| 270 | Bd/Bradi4g35950.1 | 55% (108/196) | 5-42 | CDVCESAVAVLFCA ADEAALCRSCDEKV HLCNKLASRH | 698 | 84% (32/38) |
| 274 | Zm/GRMZM2G143718_T01 | 57% (109/191) | 5-42 | CDVCESAPAVLFCA ADEAALCRPCDEKV HMCNKLASRH | 700 | 81% (31/38) |
| 276 | Zm/GRMZM2G422644_T01 | 57% (109/190) | 5-42 | CDVCESAPAVLFCA ADEAALCRPCDEKV HMCNKLASRH | 701 | 81% (31/38) |
| 304 | Gm/Glyma11g11850.1 | 57% (112/196) | 5-42 | CDVCESAAAILFCA ADEAALCSACDHKI HMCNKLASRH | 715 | 81% (31/38) |
| 272 | Os/LOC_Os09g35880.1 | 57% (113/197) | 5-42 | CDVCESAPAVLFCV ADEAALCRSCDEKV HMCNKLARRH | 699 | 78% (30/38) |

TABLE 15

Conserved second 'BBX domain' of BBX18 and closely related sequences

| Col. 1 SEQ ID NO: | Col. 2 Species/ Identifier | Col. 3 Percent identity of polypeptide in Col. 1 to BBX18 | Col. 4 BBX domain 2 in amino acid coordinates | Col. 5 Conserved BBX domain 2 | Col. 6 SEQ ID NO: of BBX domain 2 | Col. 7 Percent identity of second BBX domain in Col. 5 to second BBX domain of BBX18 |
|---|---|---|---|---|---|---|
| 278 | At/BBX18 or AT2G21320.1 | 100% (172/172) | 56-91 | CDICENAPAFFYCEI DGSSLCLQCDMVVH VGGKRTH | 721 | 100% (36/36) |
| 280 | At/AT4G38960.1 | 76% (131/171) | 56-91 | CDICENAPAFFYCEI DGSSLCLQCDMVVH VGGKRTH | 722 | 100% (36/36) |
| 306 | Gm/Glyma12g04130.1 | 63% (110/172) | 56-91 | CDICENAPAFFYCEI DGSSLCLQCDMIVH VGGKRTH | 735 | 97% (35/36) |
| 298 | Pt/POPTR_0009s12730.1 | 60% (111/184) | 56-91 | CDICENAPAFFYCEI DGSSLCLQCDMIVH VGGKRTH | 731 | 97% (35/36) |
| 302 | Sl/Solyc01g110370.2.1 | 58% (114/196) | 56-91 | CDICENAPAFFYCEI DGSSLCLQCDMIVH VGGKRTH | 733 | 97% (35/36) |
| 294 | Eg/Eucgr.I01328.1 | 57% (111/193) | 56-91 | CDICENAPAFFYCEI DGSSLCLQCDMLVH VGGKRTH | 729 | 97% (35/36) |
| 304 | Gm/Glyma11g11850.1 | 57% (112/196) | 56-91 | CDICENAPAFFYCEI DGSSLCLQCDMIVH VGGKRTH | 734 | 97% (35/36) |

TABLE 15-continued

Conserved second 'BBX domain' of BBX18 and closely related sequences

| Col. 1 SEQ ID NO: | Col. 2 Species/ Identifier | Col. 3 Percent identity of polypeptide in Col. 1 to BBX18 | Col. 4 BBX domain 2 in amino acid coordinates | Col. 5 Conserved BBX domain 2 | Col. 6 SEQ ID NO: of BBX domain 2 | Col. 7 Percent identity of second BBX domain in Col. 5 to second BBX domain of BBX18 |
|---|---|---|---|---|---|---|
| 288 | Pt/POPTR_0005s11900.1 | 61% (114/184) | 56-91 | CDICENAPAFFYCET DGSSLCLQCDMTVH VGGKRTH | 726 | 94% (34/36) |
| 290 | Pt/POPTR_0007s13830.1 | 61% (114/184) | 56-91 | CDICENAPAFFYCET DGSSLCLQCDMTVH VGGKRTH | 727 | 94% (34/36) |
| 296 | Pt/POPTR_0004s16950.1 | 60% (111/184) | 56-91 | CDICEKAPAFFYCEI DGSSLCLQCDMIVH VGGKRTH | 730 | 94% (34/36) |
| 284 | Gm/Glyma01g37370.1 | 60% (111/183) | 56-91 | CDICENAPAFFYCET DGSSLCLQCDMIVH VGGKRTH | 724 | 94% (34/36) |
| 292 | Vv/GSVIVT01018818001 | 60% (110/183) | 56-91 | CDICENAPAFFYCEI DGTSLCLQCDMIVH VGGKRTH | 728 | 94% (34/36) |
| 286 | Gm/Glyma11g07930.1 | 59% (112/189) | 56-91 | CDICENAPAFFYCET DGSSLCLQCDMIVH VGGKRTH | 725 | 94% (34/36) |
| 300 | Vv/GSVIVT01024173001 | 59% (117/198) | 56-91 | CDICENAPAFFYCEV DGTSLCLQCDMIVH VGGKRTH | 732 | 91% (33/36) |
| 272 | Os/LOC_Os09g35880.1 | 57% (113/197) | 56-91 | CDICENAPAFFYCEI DGTSLCLSCDMTVH VGGKRTH | 718 | 91% (33/36) |
| 282 | Eg/Eucgr.I02368.1 | 57% (107/185) | 56-91 | CDICENAPAFFYCEV DGTSLCLQCDMIVH VGGKRTH | 723 | 91% (33/36) |
| 274 | Zm/GRMZM2G143718_T01 | 57% (109/191) | 56-91 | CDICENSPAFFYCEI DGTSLCLSCDMTVH VGGKRTH | 719 | 88% (32/36) |
| 276 | Zm/GRMZM2G422644_T01 | 57% (109/190) | 56-91 | CDICENSPAFFYCEI DGTSLCLSCDMTVH VGGKRTH | 720 | 88% (32/36) |
| 270 | Bd/Bradi4g35950.1 | 55% (108/196) | 56-91 | CDICENSPAFFYCDI DGTSLCLSCDMAVH VGGKRTH | 717 | 86% (31/36) |

These functionally-related and/or closely-related BBX18 clade polypeptides may be identified by a first consensus BBX domain sequence (BBX1), SEQ ID NO: 854:

CDX$^3$CEX$^6$AX$^8$AX$^{10}$FCX$^{14}$ADEAALCX$^{22}$X$^{23}$CDX$^{26}$KX$^{28}$HX$^{30}$CNKLAX$^{36}$RH where X$^3$=any amino acid; X$^6$=any amino acid; X$^8$=any amino acid; X$^{10}$=I, L, V or M; X$^{11}$=F, I, L, V or M; X$^{14}$=any amino acid; X$^{22}$=any amino acid; X$^{23}$=any amino acid; X$^{26}$=any amino acid; X$^{28}$=I, L, V or M; X$^{30}$=any amino acid; and X$^{36}$=any amino acid.

These functionally-related and/or closely-related BBX18 clade polypeptides may also be identified by a second consensus BBX domain sequence (BBX2), SEQ ID NO: 855:

CDICEX$^{67}$X$^7$PAFFYCX$^{14}$X$^{15}$DGX$^{18}$SSCLX$^{23}$CDMX$^{27}$VHVGGKRTH

X$^6$=N or K; X$^7$=S or A; X$^{14}$=D or E; X$^{15}$=T, I, L, V or M; X$^{18}$=S or T; X$^{23}$=I, L, V or M; and X$^{27}$=I, L, V or M.

bHLH60 Clade Polypeptides

TABLE 16

Conserved 'bHLH domain' of bHLH60 and closely related sequences

| Col. 1 SEQ ID NO: | Col. 2 Species/ Identifier | Col. 3 Percent identity of polypeptide in Col. 1 to bHLH60 | Col. 4 bHLH domain in amino acid coordinates | Col. 5 Conserved bHLH domain | Col. 6 SEQ ID NO: of bHLH domain | Col. 7 Percent identity of bHLH domain in Col. 5 to bHLH domain of bHLH60 |
|---|---|---|---|---|---|---|
| 318 | At/bHLH60 or AT3G57800.2 | 100% (379/379) | 208-265 | RGQATDSHSLAER ARREKINARMKLL QELVPGCDKIQGTA LVLDEIINHVQSLQ RQVE | 741 | 100% (58/58) |
| 316 | At/AT2G42300.1 | 68% (261/380) | 189-246 | RGQATDNHSLAER ARREKINARMKLL QELVPGCDKIQGTA LVLDEIINHVQSLQ RQVE | 740 | 96% (56/58) |
| 330 | Cc/clementine0.9_015567m | 55% (178/321) | 242-299 | RGQATDSHSLAER ARREKINARMKLL QELVPGCNKISGTA LVLDEIINHVQSLQ RQVE | 747 | 96% (56/58) |
| 322 | Gm/Glyma03g29710.1 | 53% (190/352) | 210-267 | RGQATDSHSLAER ARREKINARMKLL QELVPGCDKISGTA MVLDEIINHVQSLQ RQVE | 743 | 96% (56/58) |
| 324 | Gm/Glyma19g32570.1 | 52% (203/388) | 204-261 | RGQATDSHSLAER ARREKINARMKLL QELVPGCDKISGTA MVLDEIINHVQSLQ RQVE | 744 | 96% (56/58) |
| 328 | Cc/clementine0.9_011877m | 51% (214/418) | 242-299 | RGQATDSHSLAER ARREKINARMKLL QELVPGCNKISGTA LVLDEIINHVQSLQ RQVE | 746 | 96% (56/58) |
| 334 | Vv/GSVIVT01033350001 | 55% (218/396) | 201-258 | RGQATDSHSLAER ARREKINARMKLL QELVPGCNKISGTA LVLDEIISHVQSLQR QVE | 749 | 94% (55/58) |
| 320 | Eg/Eucgr.A02413.1 | 52% (179/338) | 185-242 | RGQATDSHSLAER ARREKINARMKLL QELVPGCNKISGTA SVLDEIINHVQSLQ RQVE | 742 | 94% (55/58) |
| 336 | Sl/Solyc10g079070.1.1 | 47% (163/342) | 198-255 | RGQATDSHSLAER ARREKINARMKLL QELVPGCNKISGTA MVLDEIINHVQSLQ RQVE | 750 | 94% (55/58) |
| 332 | Pt/POPTR_0006s05600.1 | 53% (188/354) | 181-238 | RGQATDSHSLAER ARREKINQRMKLL QELVPGCNKISGTA LVLDEIINHVQSLQ CQVE | 748 | 93% (54/58) |
| 326 | Gm/Glyma10g12210.1 | 46% (179/386) | 196-253 | RGQATDSHSLAER ARREKINARMKLL QELVPGCNKISGTA LVLDKIINHVQSLQ NEVE | 745 | 91% (53/58) |

TABLE 16-continued

Conserved 'bHLH domain' of bHLH60 and closely related sequences

| Col. 1 SEQ ID NO: | Col. 2 Species/ Identifier | Col. 3 Percent identity of polypeptide in Col. 1 to bHLH60 | Col. 4 bHLH domain in amino acid coordinates | Col. 5 Conserved bHLH domain | Col. 6 SEQ ID NO: of bHLH domain | Col. 7 Percent identity of bHLH domain in Col. 5 to bHLH domain of bHLH60 |
|---|---|---|---|---|---|---|
| 310 | Zm/GRMZM2G074438_T01 | 43% (134/309) | 161-218 | RGQATDSHSLAER ARREKINARMELL KELVPGCSKVSGTA LVLDEIINHVQSLQ RQVE | 737 | 91% (53/58) |
| 314 | Si/Si006781m | 43% (132/307) | 177-234 | RGQATDSHSLAER ARREKINARMELL KELVPGCSKVSGTA LVLDEIINHVQSLQ RQVE | 739 | 91% (53/58) |
| 312 | Zm/GRMZM2G378653_T01 | 43% (135/309) | 184-241 | RGQATDSHSLAER ARREKINARMELL KELVPGCSKVSGTA LVLDEIINHVQSLQ RQVE | 738 | 91% (53/58) |
| 308 | Bd/Bradi1g35990.1 | 42% (147/348) | 145-202 | RGQATDSHSLAER ARREKINARMELL KELVPGCSKVSGTA LVLDEIINHVQSLQ RQVE | 736 | 91% (53/58) |

These functionally-related and/or closely-related bHLH60 clade polypeptides may be identified by a consensus bHLH domain sequence, SEQ ID NO: 856:

RGQATDX$^7$HSLAERARREKINX$^{21}$RMX$^{24}$LLX$^{27}$ELVPGCX$^{34}$KX$^{36}$X$^{37}$GTAX$^{41}$VLDX$^{45}$IIX$^{48}$HVQX$^{52}$LQX$^{55}$X$^{56}$VE where $X^7$=any amino acid; $X^{21}$=any amino acid; $X^{24}$=K or E; $X^{27}$=Q or K; $X^{34}$=any amino acid; $X^{36}$=I, L, V or M; $X^{37}$=any amino acid; $X^{41}$=any amino acid; $X^{45}$=K or E; $X^{48}$=any amino acid; $X^{52}$=S or T; $X^{55}$=any amino acid; and $X^{56}$=Q or E.

NF-YC6 Clade Polypeptides

TABLE 17

Conserved 'NF-Y/histone-like domain' of NF-YC6 and closely related sequences

| Col. 1 SEQ ID NO: | Col. 2 Species/ Identifier | Col. 3 Percent identity of polypeptide in Col. 1 to NF-YC6 | Col. 4 NF-Y/histone-like domain in amino acid coordinates | Col. 5 Conserved NF-Y/histone-like domain | Col. 6 SEQ ID NO: of NF-Y/histone-like domain | Col. 7 Percent identity of NF-Y/histone-like domain in Col. 5 to NF-Y/histone-like domain of NF-YC6 |
|---|---|---|---|---|---|---|
| 356 | At/NF-YC6 or AT5G50480.1 | 100% (202/202) | 53-117 | RQLPLARIKKIMKA DPDVHMVSAEAPII FAKACEMFIVDLT MRSWLKAEENKRH TLQKSDISNAV | 760 | 100% (65/65) |
| 348 | Si/Si015775m | 55% (57/103) | 55-119 | HSLPLARIKKIMKA DEDVKMIAAEAPV VFAKACEMFILELT LRSWLHTEGTKRR TMQRSDVSAAI | 756 | 67% (44/65) |

TABLE 17-continued

Conserved 'NF-Y/histone-like domain' of NF-YC6 and closely related sequences

| Col. 1 SEQ ID NO: | Col. 2 Species/ Identifier | Col. 3 Percent identity of polypeptide in Col. 1 to NF-YC6 | Col. 4 NF-Y/histone-like domain in amino acid coordinates | Col. 5 Conserved NF-Y/histone-like domain | Col. 6 SEQ ID NO: of NF-Y/histone-like domain | Col. 7 Percent identity of NF-Y/histone-like domain in Col. 5 to NF-Y/histone-like domain of NF-YC6 |
|---|---|---|---|---|---|---|
| 350 | At/AT5G27910.1 | 54% (92/168) | 35-99 | HDLPITRKKIMKY DPDVTMIASEAPIL LSKACEMFIMDLT MRSWLHAQESKRV TLQKSNVDAAV | 757 | 67% (44/65) |
| 338 | Bd/Bradi3g17790.1 | 52% (55/105) | 77-141 | HSLPLARIKKIMKA DEDVQMIAGEAPA VFAKACEMFILELT LRSWLQTRENNRN TLQKNDIATVV | 751 | 67% (44/65) |
| 346 | Os/LOC_Os08g10560.1 | 47% (59/125) | 380-444 | PNLPLARIKKIMKA DEDVKMIAGEAPA LFAKACEMFILDMT LRSWQHTEEGRRR TLQRSDVEAVI | 755 | 63% (41/65) |
| 340 | Bd/Bradi3g17800.1 | 48% (56/116) | 240-305 | HSLPLARIKKIMKA SGENVQMIAGEAH GLLAKACEIFIQELT LRSWLQTRENNRR TLQKNDIAAAV | 752 | 60% (40/66) |
| 344 | Bd/Bradi3g17810.1 | 51% (51/100) | 99-164 | HSLPLARIKKIMKA SGEDIRMIASEAPG LLAKASEIFIQELTL RSWLETRDNNRRT LQKNDIGAAV | 754 | 59% (39/66) |
| 352 | At/AT5G50490.1 | 45% (78/172) | 35-99 | HEFPISRIKRIMKFD PDVSMIAAEAPNLL SKACEMFVMDLTM RSWLHAQESNRLTI RKSDVDAVV | 758 | 58% (38/65) |
| 368 | Sl/Solyc03g111460.1.1 | 43% (69/158) | 64-128 | HSLPISRIKKIMKSD KEVRMISAESPILLA KACELFIQELTHRS WLKAQECQRQTLK KIDLFTVL | 766 | 58% (38/65) |
| 342 | Bd/Bradi3g17820.1 | 52% (45/85) | 7-72 | HSLPLERIKKIMKA SGENVQVIAGEAPG VLTKACEIFIQELTL RSWLQTREKNRRT LQKNDIAAAV | 753 | 56% (37/66) |
| 370 | Sl/Solyc03g111470.1.1 | 48% (45/92) | 74-138 | HSLPIFRIKKIMKSD KEVRMISAESPILLD KACELFIQELTHRS WLKAQECQRRTLK KIDFFTTE | 767 | 56% (37/65) |
| 354 | At/AT5G50470.1 | 48% (92/189) | 62-132 | HAFPLTRIKKIMKS NPEVNMVTAEAPV LISKACEMLILDLT MRSWLHTVEGGRQ TLKRSDTLTRSDIS AAT | 759 | 56% (40/71) |
| 362 | Sl/Solyc03g110840.1.1 | 49% (51/104) | 52-117 | RLLLPPTRIKKIMK KNEDVRMVAGESP VLLAKACELFIQDL | 763 | 53% (35/66) |

TABLE 17-continued

Conserved 'NF-Y/histone-like domain' of NF-YC6 and closely related sequences

| Col. 1 SEQ ID NO: | Col. 2 Species/ Identifier | Col. 3 Percent identity of polypeptide in Col. 1 to NF-YC6 | Col. 4 NF-Y/histone-like domain in amino acid coordinates | Col. 5 Conserved NF-Y/histone-like domain | Col. 6 SEQ ID NO: of NF-Y/histone-like domain | Col. 7 Percent identity of NF-Y/histone-like domain in Col. 5 to NF-Y/histone-like domain of NF-YC6 |
|---|---|---|---|---|---|---|
| | | | | TLRSSIHAQENHRRI LKKDDLTDVI | | |
| 364 | Sl/Solyc03g110850.1.1 | 46% (54/116) | 53-118 | NLLPRIHRIKKIMKT DKDVRMIATESPVL LAKACELFIQELTL RSWFKAEENHRRIL KKDDVTDVI | 764 | 53% (35/66) |
| 366 | Sl/Solyc11g016920.1.1 | 45% (53/116) | 53-118 | NLLPSINRIKKIMKT DKDVRMIATESPVL LAKACELFIQELTL RSWFKTEKNHRRIL KKDDVTDVI | 765 | 50% (33/66) |
| 360 | Sl/Solyc02g021330.1.1 | 40% (55/137) | 54-119 | NHLLPPNLIKKLMK TDEDDQMIAAESPV LLAKTCELFIQELTL RSWLNAQEKHQHI LKKDDVTDVI | 762 | 46% (31/66) |
| 358 | Sl/Solyc00g107050.1.1 | 42% (40/94) | 55-120 | NLLVSPNRIKNIMK TNKDVRRITSESPV LLAKACDFFIQELT LRSWLNAQENHRR ILKKKDVTDVI | 761 | 45% (30/66) |
| 372 | Sl/Solyc03g111450.1.1 | 40% (69/171) | 102-166 | HHFPISRIKRIIKSEN NAIKLSAETPILFSK ACELFVLELTLRSW FHAQQNNRGSLKK TDFAAAI | 768 | 44% (29/65) |

These functionally-related and/or closely-related NF-YC6 clade polypeptides may be identified by a consensus NF-Y/histone-like domain sequence, SEQ ID NO: 857:

$X^1X^2X^3X^4X^5X^6X^7X^8IKX^{11}X^{12}X^{13}KX^{15}X^{16}X^{17}X^{18}X^{19}X^{20}X^{21}$ $X^{22}X^{23}X^{24}X^{25}EX^{27}X^{28}X^{29}X^{30}X^{31}X^{32}KX^{34}X^{35}X^{36}X^{37}X^{38}X^{39}$ $X^{40}X^{41}X^{42}TX^{44}RSX^{47}X^{48}X^{49}X^{50}X^{51}X^{52}X^{53}X^{54}X^{55}X^{56}X^{57}$ $X^{58}X^{59}X^{60}X^{61}X^{62}X^{63}X^{64}X^{65}X^{66}X^{67}X^{68}X^{69}X^{70}X^{71}X^{72}X^{73}$ where $X^1$=any amino acid; $X^2$=any amino acid; $X^3$=F, I, L, V or M; $X^4$=any amino acid or absent; $X^5$=any amino acid; $X^6$=any amino acid; $X^7$=any amino acid; $X^8$=any amino acid; $X^{11}$=N, K or R; $X^{12}$=I, L, V or M; $X^{13}$=I, L, V or M; $X^{15}$=any amino acid; $X^{16}$=any amino acid; $X^{17}$=G or absent; $X^{18}$=any amino acid; $X^{19}$=N, E or D; $X^{20}$=any amino acid; $X^{21}$=any amino acid; $X^{22}$=any amino acid; $X^{23}$=I, L, V or M; $X^{24}$=A or T; $X^{25}$=A, S, T or G; $X^{27}$=A, S or T; $X^{28}$=any amino acid; $X^{29}$=any amino acid; $X^{30}$=I, L, V or M; $X^{31}$=F, I, L, V or M; $X^{32}$=any amino acid; $X^{34}$=any amino acid; $X^{35}$=S or C; $X^{36}$=E or D; $X^{37}$=F, I, L, V or M; $X^{38}$=I, L, V or M; $X^{39}$=I, L, V or M; $X^{40}$=any amino acid; $X^{41}$=E or D; $X^{42}$=I, L, V or M; $X^{44}$=any amino acid; $X^{47}$=any amino acid; $X^{48}$=any amino acid; $X^{49}$=any amino acid; $X^{50}$=A or T; $X^{51}$=any amino acid; $X^{52}$=any amino acid; $X^{53}$=any amino acid; $X^{54}$=any amino acid; $X^{55}$=Q, R; $X^{56}$=any amino acid; $X^{57}$=any amino acid; $X^{58}$=I, L, V or M; $X^{59}$=K, Q, R; $X^{60}$=R or absent; $X^{61}$=S or absent; $X^{62}$=D or absent; $X^{63}$=T or absent; $X^{64}$=L or absent; $X^{65}$=T or absent; $X^{66}$=K, R; $X^{67}$=any amino acid; $X^{68}$=N, D; $X^{69}$=F, I, L, V or M; $X^{70}$=any amino acid; $X^{71}$=any amino acid; $X^{72}$=A, T, V; and $X^{73}$=any amino acid.

bHLH121 Clade Polypeptides

TABLE 18

Conserved 'bHLH domain' of bHLH121 and closely related sequences

| Col. 1 SEQ ID NO: | Col. 2 Species/ Identifier | Col. 3 Percent identity of polypeptide in Col. 1 to bHLH121 | Col. 4 bHLH domain in amino acid coordinates | Col. 5 Conserved bHLH domain | Col. 6 SEQ ID NO: of bHLH domain | Col. 7 Percent identity of bHLH domain in Col. 5 to bHLH domain of bHLH121 |
|---|---|---|---|---|---|---|
| 388 | At/bHLH121 or AT3G19860.1 | 100% (284/284) | 6-60 | RKSQKAGREKLRR EKLNEHFVELGNV LDPERPKNDKATIL TDTVQLLKELTSEVN | 813 | 100% (5/55) |
| 390 | Cc/clementine0.9_014901m | 64% (185/288) | 60-114 | RKMQKADREKLRR DRLNEHFTELGNAL DPDRPKNDKATILA DTVQLLKDLTSQVE | 814 | 80% (44/55) |
| 392 | Cc/clementine0.9_014926m | 64% (185/288) | 60-114 | RKMQKADREKLRR DRLNEHFTELGNAL DPDRPKNDKATILA DTVQLLKDLTSQVE | 815 | 80% (44/55) |
| 400 | Pt/POPTR_0004s17540.1 | 62% (156/249) | 42-96 | RKIQKADREKLRR DRLNEHFVELGNTL DPDRPKNDKATILA DTIQLLKDLTSQVD | 819 | 80% (44/55) |
| 402 | Pt/POPTR_0009s13220.1 | 61% (176/288) | 38-92 | RKIQKADREKLRR DRLNEHFVELGNTL DPDRPKNDKATILA DTVQLLKDLNSKVD | 820 | 80% (44/55) |
| 386 | Vv/GSVIVT01018777001 | 56% (141/248) | 50-104 | RKVQKADREKLRR DRLNEHFLELGNTL DPDRPKNDKATILA DTIQMLKDLTAEVN | 812 | 78% (43/55) |
| 382 | Gm/Glyma07g26910.1 | 53% (123/232) | 56-110 | RKVLKADREKLRR DRLNEHFQELGNA LDPDRPKNDKATIL TETVQMLKDLTAE VN | 810 | 78% (43/55) |
| 394 | Gm/Glyma08g15740.1 | 65% (157/238) | 7-61 | RKTQKADREKLRR DRLNEQFVELGNIL DPDRPKNDKATIIG DTIQLLKDLTSQVS | 816 | 76% (42/55) |
| 398 | Gm/Glyma12g02740.1 | 57% (137/239) | 7-61 | RKTQKADREKLRR DRFNVQFVELGNIL DPDRPKNDKATILG DTIQLLKDLTSEVS | 818 | 76% (42/55) |
| 396 | Gm/Glyma15g29630.1 | 63% (151/238) | 21-75 | RKTQKADREKLRR DRINEQFVELGNIL DPDRPKNDKATILC DTIQLLKDLISQVS | 817 | 74% (41/55) |
| 404 | Vv/GSVIVT01024084001 | 57% (166/288) | 46-100 | RKVQKADREKLRR DRLNEQFIELGNAL DPDRPKNDKATILS DTIQLLKDLTAQVE | 821 | 74% (41/55) |
| 384 | Pt/POPTR_0005s11550.1 | 51% (116/227) | 61-115 | KKVQKADREKLRR DNLNEQFLELGTTL DPDRPKNDKATILT DTIQVLKDLTAEVN | 811 | 74% (41/55) |
| 378 | Si/Si017804m | 48% (130/268) | 36-90 | RKVQKADREKMRR DKLNEQFQELGNT LDPDRPRNDKATIL GDTIQMLKDLTSH VN | 808 | 74% (41/55) |

TABLE 18-continued

Conserved 'bHLH domain' of bHLH121 and closely related sequences

| Col. 1 SEQ ID NO: | Col. 2 Species/ Identifier | Col. 3 Percent identity of polypeptide in Col. 1 to bHLH121 | Col. 4 bHLH domain in amino acid coordinates | Col. 5 Conserved bHLH domain | Col. 6 SEQ ID NO: of bHLH domain | Col. 7 Percent identity of bHLH domain in Col. 5 to bHLH domain of bHLH121 |
|---|---|---|---|---|---|---|
| 406 | St/Solyc01g111130.2.1 | 61% (151/247) | 57-111 | RKVQKADREKLRR DRLNEQFMELGKT LDPDRPKNDKASIL SDTVQILKDLTAQVS | 822 | 70% (39/55) |
| 408 | Zm/GRMZM2G114444_T02 | 50% (119/236) | 30-84 | RKVQKADREKMRR DKLNEQFQDLGNA LDPDRPRNDKATIL GDTIQMLKDLTTQ VN | 823 | 70% (39/55) |
| 374 | Bd/Bradi3g11520.1 | 49% (127/256) | 40-94 | RKVQKADRERMRR DKLNEQFQELGTTL DPDRPRNDKATILG DTIQMLKDLSSQVN | 806 | 69% (38/55) |
| 376 | Os/LOC_Os02g23823.1 | 48% (116/241) | 40-94 | RKVQKADREKMRR DRLNEQFQELGSTL DPDRPRNDKATILS DAIQMLKDLTSQVN | 807 | 69% (38/55) |
| 380 | At/AT4G36063800.1 | 65% (68/104) | 41-99 | KKEAVCSQKAERE KLRRDKLKEQFLEL GNALDPNRPKSDK ASVLTDTIQMLKD VMNQVD | 809 | 61% (36/59) |

TABLE 19

Conserved 'putative leucine zipper domain' of bHLH121 and closely related sequences

| Col. 1 SEQ ID NO: | Col. 2 Species/ Identifier | Col. 3 Percent identity of polypeptide in Col. 1 to bHLH121 | Col. 4 Putative leucine zipper domain in amino acid coordinates | Col. 5 Conserved putative leucine zipper domain | Col. 6 SEQ ID NO: of putative leucine zipper domain | Col. 7 Percent identity of putative leucine zipper domain in Col. 5 to putative leucine zipper domain of bHLH121 |
|---|---|---|---|---|---|---|
| 388 | At/bHLH121 or AT3G19860.1 | 100% (284/284) | 61-97 | KLKSEYTALTDESR ELTQEKNDLREEKT SLKSDIENL | 831 | 100% (37/37) |
| 406 | Sl/Solyc01g111130.2.1 | 61% (151/247) | 112-148 | RLKSEYAALTDESR ELTQEKNDLREEK ASLKSDIESL | 840 | 89% (33/37) |
| 394 | Gm/Glyma08g15740.1 | 65% (157/238) | 62-98 | KLKDEYATLNEESR ELTQEKNDLREEK ASLKSDIGNL | 834 | 81% (30/37) |
| 390 | Cc/clementine0.9_014901m | 64% (185/288) | 115-151 | KLKTEHAALTEESR ELTQEKNDLREEKL SLRSEIENL | 832 | 81% (30/37) |
| 392 | Cc/clementine0.9_014926m | 64% (185/288) | 115-151 | KLKTEHAALTEESR ELTQEKNDLREEKL SLRSEIENL | 833 | 81% (30/37) |

TABLE 19-continued

Conserved 'putative leucine zipper domain' of bHLH121 and closely related sequences

| Col. 1 SEQ ID NO: | Col. 2 Species/Identifier | Col. 3 Percent identity of polypeptide in Col. 1 to bHLH121 | Col. 4 Putative leucine zipper domain in amino acid coordinates | Col. 5 Conserved putative leucine zipper domain | Col. 6 SEQ ID NO: of putative leucine zipper domain | Col. 7 Percent identity of putative leucine zipper domain in Col. 5 to putative leucine zipper domain of bHLH121 |
|---|---|---|---|---|---|---|
| 400 | Pt/POPTR_0004s17540.1 | 62% (156/249) | 97-133 | KLKAEYATLSEESL ELTQEKNDLREEK ASLKSDIENL | 837 | 81% (30/37) |
| 402 | Pt/POPTR_0009s13220.1 | 61% (176/288) | 93-129 | KLKAEHAALSEESR ELTLEKNDLREEKA SLKSDVENL | 838 | 78% (29/37) |
| 396 | Gm/Glyma15g29630.1 | 63% (151/238) | 76-112 | KLKDEYAMLNEES RELTLEKTDLREEK ASLKSDIDNL | 835 | 75% (28/37) |
| 404 | Vv/GSVIVT01024084001 | 57% (166/288) | 101-137 | KLKAENASLNEESR ELTQEKNDLREEK ASLKSATENL | 839 | 75% (28/37) |
| 382 | Gm/Glyma07g26910.1 | 53% (123/232) | 111-147 | RLKTEHKTLSEESR ELMQEKNELREEK TSLKSDIENL | 828 | 75% (28/37) |
| 374 | Bd/Bradi3g11520.1 | 49% (127/256) | 95-131 | KLKAEYSSLSEEER ELTQEKNELRDEK ASLKSDIDNL | 824 | 72% (27/37) |
| 398 | Gm/Glyma12g02740.1 | 57% (137/239) | 62-98 | KLKDEYATLNEESC ELAQEKNELREEK ASLKSDILKL | 836 | 70% (26/37) |
| 386 | Vv/GSVIVT01018777001 | 56% (141/248) | 105-141 | RLKVECAALSEESR ELVQEKNELREEK VALKSDIDNL | 830 | 70% (26/37) |
| 378 | Si/Si017804m | 48% (130/268) | 91-127 | KLKAEYTSLSEEAR ELTQEKNELRDEK ASLKSEVDNL | 826 | 70% (26/37) |
| 380 | At/AT4G36060.1 | 65% (68/104) | 100-136 | RLKAEYETLSQESR ELIQEKSELREEKA TLKSDIEIL | 827 | 67% (25/37) |
| 408 | Zm/GRMZM2G114444_T02 | 50% (119/236) | 85-121 | KLKAEYTSLSEEAC ELTQEKNELRDEK ASLKSEVDNL | 841 | 67% (25/37) |
| 376 | Os/LOC_Os02g23823.1 | 48% (116/241) | 95-131 | KLKAEYTSLSEEAR ELTQEKNELRDEK VSLKFEVDNL | 825 | 67% (25/37) |
| 384 | Pt/POPTR_0005s11550.1 | 51% (116/227) | 116-152 | RLKAECATLSEETH ELMQEKNELREEK ASLKADTENL | 829 | 62% (23/37) |

These functionally-related and/or closely-related bHLH121 clade polypeptides may be identified by a consensus bHLH domain sequence, SEQ ID NO: 858:

$X^1KX^3X^4X^5X^6X^7X^8KAX^{11}REX^{14}X^{15}RRX^{18}X^{19}X^{20}X^{21}X^{22}X^{23}F$ $X^{25}X^{26}LGX^{29}X^{30}LDPX^{34}RPX^{37}X^{38}DKAX^{42}X^{43}X^{44}X^{45}X^{46}X^{47}$ $X^{48}QX^{50}LKX^{53}X^{54}X^{55}X^{56}X^{57}VX^{59}$ where $X^1$=K or R; $X^3$=E or absent; $X^4$=A or absent; $X^5$=V or absent; $X^6$=C or absent; $X^7$=any amino acid; $X^8$=any amino acid; $X^{11}$=any amino acid; $X^{14}$=K or R; $X^{15}$=I, L, V or M; $X^{18}$=D or E; $X^{19}$=N, K or R; $X^{20}$=F, I, L, V or M; $X^{21}$=N or K; $X^{22}$=any amino acid; $X^{23}$=H or Q; $X^{25}$=any amino acid; $X^{26}$=D or E; $X^{29}$=any amino acid; $X^{30}$=any amino acid; $X^{34}$=N, D or E; $X^{37}$=K or R; $X^{38}$=any amino acid; $X^{42}$=S or T; $X^{43}$=I, L, V or M; $X^{44}$=I, L, V or M; $X^{45}$=any amino acid; $X^{46}$=D, E; $X^{47}$=A or T; $X^{48}$=I, L, V or M; $X^{50}$=I, L, V or M; $X^{53}$=D or E; $X^{54}$=I, L, V or M; $X^{55}$=any amino acid; $X^{56}$=any amino acid; $X^{57}$=any amino acid; and $X^{59}$=any amino acid.

These functionally-related and/or closely-related bHLH121 clade polypeptides may also be identified by a consensus putative leucine zipper domain sequence, SEQ ID NO: 859:

$X^1LKX^4EX^6X^7X^8LX^{10}X^{11}EX^{13}X^{14}ELX^{17}X^{18}EKX^{21}X^{22}LRX^{25}EK$
$X^{28}X^{29}LX^{31}X^{32}X^{33}X^{34}X^{35}X^{36}L$ where $X^1$=R or K; $X^4$=any amino acid; $X^6$=any amino acid; $X^7$=any amino acid; $X^8$=any amino acid; $X^{10}$=any amino acid; $X^{11}$=Q, D or E; $X^{13}$=any amino acid; $X^{14}$=any amino acid; $X^{17}$=A, I, L, V or M; $X^{18}$=any amino acid; $X^{21}$=any amino acid; $X^{22}$=D or E; $X^{25}$=D or E; $X^{28}$=any amino acid; $X^{29}$=S, A or T; $X^{31}$=K or R; $X^{32}$=any amino acid; $X^{33}$=any amino acid; $X^{34}$=T, I, L, V or M; $X^{35}$=any amino acid; and $X^{36}$=any amino acid.

BBX26 Clade Polypeptides

These functionally-related and/or closely-related BBX26 clade polypeptides may be identified by a consensus BBX domain sequence, SEQ ID NO: 860:

$CX^2X^3CX^5X^6X^7X^8X^9X^{10}\ X^{11}X^{12}CX^{14}X^{15}X^{16}X^{17}X^{18}X^{19}X^{20}CL$
$X^{23}CDX^{26}X^{27}X^{28}HX^{30}X^{31}NX^{33}X^{34}X^{35}X^{36}X^{37}H$ where $X^2$=any amino acid; $X^3$=any amino acid; $X^5$=any amino acid; $X^6$=any amino acid; $X^7$=Y, I, L, V, or M; $X^8$=any amino acid; $X^9$=A or P; $X^{10}$=I, L, V, or M; $X^{11}$=I, L, V, or M; $X^{12}$=any amino acid; $X^{14}$=any amino acid; $X^{15}$=A or T; $X^{16}$=D or E; $X^{17}$=A or T; $X^{18}$=any amino acid; $X^{19}$=any amino acid; $X^{20}$=F, I, L, V, or M; $X^{23}$=S or T; $X^{26}$=any amino acid; $X^{27}$=any amino acid; $X^{28}$=any amino acid; $X^{30}$=any amino acid; $X^{31}$=A or absent; $X^{33}$=any amino acid; $X^{34}$=I, L, V, or M; $X^{35}$=any amino acid; $X^{36}$=any amino acid; and $X^{37}$=any amino acid.

TABLE 20

Conserved 'BBX domain' of BBX26 and closely related sequences

| Col. 1 SEQ ID NO: | Col. 2 Species/ Identifier | Col. 3 Percent identity of polypeptide in Col. 1 to BBX26 | Col. 4 BBX domain in amino acid coordinates | Col. 5 Conserved BBX domain | Col. 6 SEQ ID NO: of BBX domain | Col. 7 Percent identity of BBX domain in Col. 5 to BBX domain of BBX26 |
|---|---|---|---|---|---|---|
| 410 | At/BBX26 or AT1G60250.1 | 100% (251/251) | 5-41 | CHTCRHVTAVIHC VTEALNFCLTCDNL RHHNNIHAEH | 769 | 100% (37/37) |
| 412 | At/AT1G68190.1 | 33% (28/84) | 14-51 | CEFCKAYRAVVYCI ADTANLCLTCDAK VHSANSLSGRH | 770 | 36% (14/38) |
| 414 | Pt/POPTR_0008s12410.1 | 33% (24/71) | 5-42 | CEFCMALRPVVYC NADAAYLCLSCDA KVHSANALFNRH | 771 | 31% (12/38) |
| 420 | Sl/Solyc04g007470.2 | 26% (25/94) | 7-44 | CEFCMLLKPVVYC EADAAHLCLSCDA KVHSANALSNRH | 774 | 31% (12/38) |
| 416 | Gm/Glyma10g41540.1 | 27% (22/79) | 5-42 | CEFCTALRPLVYCK ADAAYLCLSCDAK VHLANAVSGRH | 772 | 28% (11/38) |
| 418 | Gm/Glyma20g25700.1 | 27% (22/79) | 5-42 | CEFCTALRPLVYCK ADAAYLCLSCDSK VHLANAVSGRH | 773 | 28% (11/38) | bHLH121 Clade Polypeptides

TABLE 21

Conserved 'Methyltransferase domain' of PMT24 and closely related sequences

| Col. 1 SEQ ID NO: | Col. 2 Species/ Identifier | Col. 3 Percent identity of polypeptide in Col. 1 to PMT24 | Col. 4 Methyltransferase domain in amino acid coordinates | Col. 5 Conserved methyltransferase domain | Col. 6 SEQ ID NO: of methyltransferase domain | Col. 7 Percent identity of methyltransferase domain in Col. 5 to methyltransferase domain of PMT24 |
|---|---|---|---|---|---|---|
| 444 | At/bHLH121 or AT1G29470.1 | 100% (770/770) | 367-584 | VILDVGCGVASFGG YLFDRDVLALSFAP KDEHEAQVQFALE RGIPAMSNVMGTK RLPFPGSVFDLIHC ARCRVPWHIEGGK LLLELNRALRPGGF FVWSATPVYRKTE EDVGIWKAMSKLT KAMCWELMTIKKD ELNEVGAAIYQKP MSNKCYNERSQNE PPLCKDSDDQNAA WNVPLEACIHKVT EDSSKRGAVWPES WPERVETVPQWLD SQEGVY | 786 | 100% (218/218) |
| 446 | At/AT2G34300.1 | 81% (638/783) | 367-584 | VILDVGCGVASFGG YLFERDVLALSFAP KDEHEAQVQFALE RGIPAMLNVMGTK RLPFPGSVFDLIHC ARCRVPWHIEGGK LLLELNRALRPGGF FVWSATPVYRKNE EDSGIWKAMSELT KAMCWKLVTIKKD KLNEVGAAIYQKPT SNKCYNKRPQNEPP LCKDSDDQNAAW NVPLEACMHKVTE DSSKRGAVWPNM WPERVETAPEWLD SQEGVY | 787 | 92% (202/218) |
| 450 | Pt/POPTR_0005s20670.1 | 66% (548/826) | 423-640 | VILDVGCGVASFGG YLFERDVLAMSFAP KDEHEAQVQFALE RGIPAMLAVMGTK RLPFPSSVFDVVHC ARCRVPWHVEGGK LLLELNRVLRPGGY FVWSATPVYQKLP EDVGIWKAMSKLT KSMCWDLVVIKKD KLNGVGAAIFRKPT SNDCYNNRPQNEPP LCKESDDPNAAWN VPLEACMHKVPED ASVRGSRWPEQWP QRLEKPPYWLNSQ VGVY | 789 | 81% (177/218) |
| 448 | Pt/POPTR00_02s07640.1 | 64% (526/815) | 412-629 | VILDVGCGVASFGG YLLEKDVLAMSFA PKDEHEAQVQFAL ERGIPAMLAVMGT KRLPFPNSVFDLVH CARCRVPWHIEGG KLLLELNRVLRPGG YFVWSATPVYRKR PEDVGIWKAMSKL TKSMCWDLVVIKT | 788 | 80% (176/218) |

TABLE 21-continued

Conserved 'Methyltransferase domain' of PMT24 and closely related sequences

| Col. 1 SEQ ID NO: | Col. 2 Species/ Identifier | Col. 3 Percent identity of polypeptide in Col. 1 to PMT24 | Col. 4 Methyltransferase domain in amino acid coordinates | Col. 5 Conserved methyltransferase domain | Col. 6 SEQ ID NO: of methyltransferase domain | Col. 7 Percent identity of methyltransferase domain in Col. 5 to methyltransferase domain of PMT24 |
|---|---|---|---|---|---|---|
| | | | | DTLNGVGAAIYRK PTSNDCYNNRPQN EPPLCKESDDPNAA WNVLLEACMHKVP VDASVRGSHWPEQ WPKRLEKPPYWLN SQVGVY | | |
| 478 | Pt/POPTR_0005s06640.1 | 62% (499/803) | 392-610 | VILDVGCGVASFGG YLFDRDVLAMSFA PKDEHEAQIQFALE RGIPAISAVMGTKR LPYPGRVFDAVHC ARCRVPWHIEGGK LLLELNRVLRPGGF FVWSATPVYQKLA EDVEIWQAMTELT KAMCWELVSINKD TLNGVGVATYRKP TSNDCYEKRSKQEP PLCEASDDPNAAW NVPLQACMHKVPV GSLERGSQWPEQW PARLDKTPYWMLS SQVGVY | 803 | 75% (166/219) |
| 468 | Gm/Glyma04g38870.1 | 62% (494/794) | 390-608 | VILDVGCGVASFGG FLFDRDVLAMSLAP KDEHEAQVQFALE RGIPAISAVMGTKR LPFPGKVFDVVHC ARCRVPWHIEGGK LLLELNRVLRPGGF FVWSATPIYQKLPE DVEIWKAMKTLTK AMCWEVVSISKDQ VNGVGVAVYKKPT SNECYEQRSKNEPP LCPDSDDPNAAWN IKLQACMHKVPASS KERGSKLPELWPA RLTKVPYWLLSSQ VGVY | 798 | 75% (165/219) |
| 480 | Pt/POPTR_0007s04340.1 | 61% (506/829) | 420-638 | VILDVGCGVASFGG YLFDRDVLTMSFAP KDEHEAQVQFALE RGIPAISAVMGTKR LPYPGRVFDAVHC ARCRVPWHIEGGK LLLELNRVLRPGGL FVWSATPVYQKLA EDVEIWQAMTELT KAMCWELVSINKD TINGVGVATYRKPT SNDCYEKRSKQEPP LCEASDDPNAAWN VPLQACMHKVPVD SLERGSQWPEQWP ARLGKTPYWMLSS QVGVY | 804 | 75% (165/219) |
| 428 | Si/Si000354m | 60% (486/810) | 397-615 | VILDVGCGVASFGG YMFDRDVLTMSFA PKDEHEAQVQFAL ERGIPAISAVMGTK | 778 | 75% (166/219) |

TABLE 21-continued

Conserved 'Methyltransferase domain' of PMT24 and closely related sequences

| Col. 1 SEQ ID NO: | Col. 2 Species/ Identifier | Col. 3 Percent identity of polypeptide in Col. 1 to PMT24 | Col. 4 Methyltransferase domain in amino acid coordinates | Col. 5 Conserved methyltransferase domain | Col. 6 SEQ ID NO: of methyl- transferase domain | Col. 7 Percent identity of methyl- transferase domain in Col. 5 to methyl- transferase domain of PMT24 |
|---|---|---|---|---|---|---|
| | | | | RLPYPSRVFDVIHC ARCRVPWHIEGGM LLLELNRLLRPGGY FVWSATPVYQKLP EDVEIWNAMSALT KSMCWKMVNKTK DKLNQVGMAIYQK PMDNNCYEKRSEN NPPLCKDSDDADA AWNVPLEACMHKL PAGPTVRGAKWPE SWPQRLEKTPFWL NGSQVGVY | | |
| 466 | Eg/Eucgr.I00186.1 | 59% (487/819) | 410-628 | VILDVGCGVASFGG YLFDRDVLAMSLA PKDEHEAQVQFAL ERGIPAISAVMGTT RLPFPSRVFDIVHC ARCRVPWHIEGGK LLLELNRLLRPGGF FVWSATPVYQKIPD DVAIWKAMSALLK SMCWELISINKDTL NGVGVATYRKPMS NECYEKRSQNDPP MCADSDDSNAAW YVPLQTCMHKIPID SAERGSQWPEEWP ARLVKTPYWLLSS QVGVY | 797 | 75% (165/219) |
| 470 | Gm/Glyma06g16050.1 | 62% (503/810) | 402-620 | VILDVGCGVASFGG FLFDRDVLAMSLAP KDEHEAQVQFALE RGIPAISAVMGTKR LPFPGKVFDVVHC ARCRVPWHIEGGK LLLELNRVLRPGGF FVWSATPIYQKLPE DVEIWKAMKALTK AMCWEVVSISKDP VNGVGAVYRKPT SNECYEQRSKNEPP LCPDSDDPNAAWN IQLQACLHKAPVSS KERGSKLPELWPA RLIKVPYWLSSSQV GVY | 799 | 74% (164/219) |
| 482 | Vv/GSVIVT01026451001 | 61% (480/775) | 357-575 | VVLDVGCGVASFG GYLFDKDVLTMSF APKDEHEAQVQFA LERGIPGISAVMGT KRLPFPAMVFDVV HCARCRVPWHIEG GKLLLELNRVLRPG GFFVWSATPVYQK LADDVAIWNAMTE LMKSMCWELVVIK RDVVNRVAAAIYK KPTSNDCYEKRSQ NEPPICADSEDANA AWNVPLQACMHK | 805 | 74% (164/219) |

TABLE 21-continued

Conserved 'Methyltransferase domain' of PMT24 and closely related sequences

| Col. 1 SEQ ID NO: | Col. 2 Species/ Identifier | Col. 3 Percent identity of polypeptide in Col. 1 to PMT24 | Col. 4 Methyltransferase domain in amino acid coordinates | Col. 5 Conserved methyltransferase domain | Col. 6 SEQ ID NO: of methyl- transferase domain | Col. 7 Percent identity of methyl- transferase domain in Col. 5 to methyl- transferase domain of PMT24 |
|---|---|---|---|---|---|---|
| | | | | VPVDASKRGSQWP ELWPARLDKSPYW LTSSQVGVY | | |
| 452 | Eg/Eucgr.F04285.1 | 55% (465/832) | 423-639 | VILDVGCGVASFGG YLFERDVLTMSFAP KDVHEAQVQFALE RGIPAILGVMGTKR LPFPGGVFDVIHCA RCRVPWHIEGGKL LLELNRVLRPGGYF LWSATPIYRRDQED IGIWKEMSKLTMA MCWDLVMIKKDK LNKVAIAMYRKPT SNECYEKRPQNEPP LCDNFDDPNSAWN VTLQACMHKVPVD MSKRGSNWPEKWP VRLEKPPYWLNEL GVY | 790 | 74% (162/218) |
| 460 | Vv/GSVIVT01008776001 | 73% (409/554) | 150-368 | VILDVGCGVASFGG YIFERDVLAMSFAP KDEHEAQVQFALE RGIPAISAVMGTTR LPFPSRVFDVVHCA RCRVPWHIEGGKL LLELNRVLRPGGYF VWSATPVYRKVPE DVGIWNAMSEITK KICWDLVAMSKDS LNGIGAAIYRKPTS NECYEKRPRNEPPL CEESDNADAAWNI PLQACMHKVPVLT SERGSQWPEQWPL RVEKAPNWLKSSQ VGVY | 794 | 73% (162/219) |
| 462 | Sl/Solyc04g063230.2.1 | 59% (470/784) | 364-582 | VILDVGCGVASFGG YLFERDVLAMSLA PKDEHEAQVQFAL ERGIPAISAVMGTK RLPFPGKVFDAVHC ARCRVPWHIEGGK LLLELNRVLRPGGH FIWSATPVYRKDEE NVGIWEAMSELTK SMCWELLEINEDKL NEVGVAIFRKPTTN DCYQSRTQNDPPM CEEADDPDAAWNI TLQACLHKAPADA SARGAKWPAKWPL RSEKLPYWLKSSQ VGVY | 795 | 73% (162/219) |
| 426 | Zm/GRMZM2G049269_T01 | 59% (479/801) | 392-610 | VILDVGCGVASFGG YMFDRDALTMSFA PKDEHEAQVQFAL ERGIPAISAVMGTK RLPYPSRVFDVIHC ARCRVPWHIEGGM LLLELNRLLRPGGY FVWSATPVYQKLP | 777 | 73% (160/219) |

TABLE 21-continued

Conserved 'Methyltransferase domain' of PMT24 and closely related sequences

| Col. 1 SEQ ID NO: | Col. 2 Species/ Identifier | Col. 3 Percent identity of polypeptide in Col. 1 to PMT24 | Col. 4 Methyltransferase domain in amino acid coordinates | Col. 5 Conserved methyltransferase domain | Col. 6 SEQ ID NO: of methyltransferase domain | Col. 7 Percent identity of methyltransferase domain in Col. 5 to methyltransferase domain of PMT24 |
|---|---|---|---|---|---|---|
| | | | | EDVEIWNAMSTLT KSMCWKMVNKTK DKLNQVGMVIYQK PMDNICYEKRSENS PPLCKESDDADAA WNVPLEACMHKLP GGSKVRGSKWPEL WPQRLEKTPFWID GSKVGVY | | |
| 476 | Sl/Solyc05g056580.2.1 | 59% (486/818) | 409-627 | VILDVGCGVASFGG YLFERDVLAMSLA PKDEHEAQVQFAL ERGIPAISAVMGTK RLPFPSRVFDVVHC ARCRVPWHIEGGK LLLELNRVLRPGGL FVWSATPVYQKLP EDVEIWEAMQKLT KAMCWDLVSKTK DRVNGVGVAVYR KPTSNECYEQRSKD APPICQGSDDPNAA WNVPLQACMHKA PVATSERGSQWPEP WPARLSKSPYWLL SSQVGVY | 802 | 73% (160/219) |
| 474 | Gm/Glyma08g00320.1 | 58% (493/847) | 438-656 | VILDVGCGVASFGG FLFERDVLTMSLAP KDEHEAQVQFALE RGIPAISAVMGTKR LPYPGRVFDVVHC ARCRVPWHIEGGK LLLELNRVLRPGGF FVWSATPIYQKLPE DVEIWNEMKALTK AMCWEVVSISKDK LNGVGIAVYKKPTS NECYEKRSQNQPPI CPDSDDPNAAWNV PLQACMHKVPVSS TERGSQWPEKWPA RLTNIPYWLTNSQV GVY | 801 | 73% (162/219) |
| 472 | Gm/Glyma05g32670.1 | 58% (492/837) | 427-645 | VILDVGCGVASFGG FLFERDVLTMSLAP KDEHEAQVQFALE RGIPAISAVMGTKR LPYPGRVFDVVHC ARCRVPWHIEGGK LLLELNRVLRPGGF FVWSATPIYQKLPE DVEIWNEMKALTK AMCWEVVSISKDK LNGVGIAVYKKPTS NECYEKRSQNQPPI CPDSDDPNAAWNIP LQACMHKVPVSST ERGSQWPEKWPAR LTNTPYWLTNSQV GVY | 800 | 73% (161/219) |

TABLE 21-continued

Conserved 'Methyltransferase domain' of PMT24 and closely related sequences

| Col. 1 SEQ ID NO: | Col. 2 Species/ Identifier | Col. 3 Percent identity of polypeptide in Col. 1 to PMT24 | Col. 4 Methyltransferase domain in amino acid coordinates | Col. 5 Conserved methyltransferase domain | Col. 6 SEQ ID NO: of methyltransferase domain | Col. 7 Percent identity of methyltransferase domain in Col. 5 to methyltransferase domain of PMT24 |
|---|---|---|---|---|---|---|
| 456 | Gm/Glyma04g42270.1 | 56% (473/835) | 429-646 | VILDVGCGVASFGG YLFEKDVLTMSFAP KDVHEAQVQFALE RGIPATLGVMGTV RLPYPGSVFDLVHC ARCRVPWHIEGGK LLLELNRVLRPGGH FVWSATPVYQKDP EDVEIWKAMGEIT KSMCWDLVVIAKD KLNGVAAAIYRKP TDNECYNNRIKHEP PMCSESDDPNTAW NVSLQACMHKVPV DASERGSIWPEQWP LRLEKPPYWIDSQA GVY | 792 | 73% (160/218) |
| 422 | Bd/Bradi2g57087.1 | 59% (485/810) | 394-612 | VILDVGCGVASFGG YMFDRDVLTMSFA PKDEHEAQVQFAL ERGIPAISAVMGTK RLPYPSRVFDVIHC ARCRVPWHIEGGK LLLELNRLLRPGGY FVWSATPVYQKLP EDVEIWNAMSSLT KSMCWKMVKKTK DTLNQVGMAIYQK PMDNNCYEKRSED SPPLCKETDDADAS WNITLQACIHKLPV GPSVRGSKWPEFW PQRLEKTPFWIDGS HVGVY | 775 | 72% (158/219) |
| 424 | Os/LOC_Os01g66110.1 | 58% (479/812) | 406-624 | VILDVGCGVASFGG YMFERDVLTMSFA PKDEHEAQVQFAL ERGIPAISAVMGTK RLPYPSRVFDVIHC ARCRVPWHIEGGM LLLELNRLLRPGGY FVWSATPVYQKLP EDVEIWNAMSSLT KAMCWKMVNKTK DKLNQVGMAIYQK PMDNSCYEKRPEN SPPLCKETDDADAA WNVPLQACMHKLP AGQSVRGSKWPET WPQRLEKTPYWID DSHVGIY | 776 | 72% (159/219) |
| 464 | At/AT5G64030.1 | 58% (490/834) | 425-643 | VVLDVGCGVASFG GFLFDRDVITMSLA PKDEHEAQVQFAL ERGIPAISAVMGTT RLPFPGRVFDIVHC ARCRVPWHIEGGK LLLELNRVLRPGGF FVWSATPVYQKKT EDVEIWKAMSELIK KMCWELVSINKDTI NGVGVATYRKPTS | 796 | 72% (159/219) |

TABLE 21-continued

Conserved 'Methyltransferase domain' of PMT24 and closely related sequences

| Col. 1 SEQ ID NO: | Col. 2 Species/ Identifier | Col. 3 Percent identity of polypeptide in Col. 1 to PMT24 | Col. 4 Methyltransferase domain in amino acid coordinates | Col. 5 Conserved methyltransferase domain | Col. 6 SEQ ID NO: of methyl- transferase domain | Col. 7 Percent identity of methyl- transferase domain in Col. 5 to methyl- transferase domain of PMT24 |
|---|---|---|---|---|---|---|
| | | | | NECYKNRSEPVPPI CADSDDPNASWKV PLQACMHTAPEDK TQRGSQWPEQWPA RLEKAPFWLSSSQT GVY | | |
| 458 | Gm/Glyma06g12540.1 | 57% (464/811) | 406-623 | VILDVGCGVASFGG YLFEKDVLTMSFAP KDVHEAQVQFALE RGIPATLGVMGTV RLPYPGSVFDLLHC ARCRVPWHVEGGK LLLELNRVLRPGGY FVWSATPVYQKDP EDVEIWKAMGEIT KSMCWDLVVIAKD KLNGVAAAIYRKP TDNECYNNRIKNEP SMCSESDDPNTAW NVSLQACMHKVPV DASERGSIWPEQWP LRLEKPPYWIDSQA GVY | 793 | 72% (159/218) |
| 438 | Bd/Bradi4g23610.1 | 50% (440/868) | 469-688 | VVLDVGCGVASFG GFLFDRGALTMSFA PKDEHEAQVQFAL ERGIPALSAVMGTK RLPFPAGVFDVVHC ARCRVPWHIDGGM LLLELNRLLRPGGF FVWSATPVYQKLP EDVEIWDDMVKLT KAMCWEMVKKTE DTLDQVGLVIFRKP KSNRCYETRRQKEP PLCDGSDDPNAAW NIKLRACMHRAPA DYPSVRGSRWPAP WPERAEAVPYWLN NSQVGVY | 783 | 70% (155/220) |
| 434 | Zm/GRMZM2G002642_T02 | 69% (387/557) | 271-489 | VVLDVGCGVASFG GYLFDRDVITMSFA PKDEHEAQVQFAL ERGIPAISAVMGTK RLPFPSRVFDVVHC ARCRVPWHIEGGK LLLELDRLLRPGGY FVWSATPVYQKLP EDVEIWQAMSALT SSMCWKMVNKVK DRVNRVGIAIYRKP TDNSCYEARSETNP PLCGEYDDPDAAW NISLGACMHKLPV DPTVRGSQWPELW PLRLEKPPYWLRGS EAGVY | 781 | 69% (152/219) |
| 440 | Os/LOC_Os11g08314.1 | 57% (418/726) | 468-686 | VALDVGCGVASFG GYLFDHDVLTMSL APKDEHEAQVQFA LERGIPAISAVMGT RRLPFPSNVFDAVH | 784 | 69% (153/219) |

TABLE 21-continued

Conserved 'Methyltransferase domain' of PMT24 and closely related sequences

| Col. 1 SEQ ID NO: | Col. 2 Species/ Identifier | Col. 3 Percent identity of polypeptide in Col. 1 to PMT24 | Col. 4 Methyltransferase domain in amino acid coordinates | Col. 5 Conserved methyltransferase domain | Col. 6 SEQ ID NO: of methyl-transferase domain | Col. 7 Percent identity of methyl-transferase domain in Col. 5 to methyl-transferase domain of PMT24 |
|---|---|---|---|---|---|---|
| | | | | CARCRVPWHIEGG MLLLELNRLLRPGG FFVWSATPVYQELP EDVEIWGEMVKLT KAMCWEMVSKTS DTVDQVGLVTFRK PADNACYMKRRQK EPPLCEPSDDPNAA WNITLRACMHWVP TDPSVRGSWWPER WPERMEKTPYWLN SSQVGVY | | |
| 430 | Bd/Bradi5g27590.1 | 55% (429/773) | 319-537 | VVLDVGCGVASFG GYLFDRDVLTMSF APKDEHEAQVQFA LERGIPAISAVMGT KRLPFPGRVFDAVH CARCRVPWHIEGG KLLLELDRLLRPGG YFVWSATPAYQKL PEDVEIWQAMSAL TRSMCWKMVNKV KDRLNRVGVAIFQ KPIDNRCYDGRSAA NLPLCGEYDNVDA AWNVSLESCIHKLP VDPAIRSSRWPEEW PLRLERAPYWLKSS EPGVY | 779 | 69% (153/219) |
| 454 | Eg/Eucgr.F04286.1 | 54% (441/813) | 407-624 | VILDVGCGVGSFGG YLFERDVLTMSFAP KDEHEAQVQFALE RGIPAMLAVMGTK RLPFPSGVFDAIHC ARCRVPWHIEGGK LLLELNRLLRPGGY FVWSATPIYRKGPE DLGIWKEMSKLTT AMCWNFTLIKRKD KMNKVSIALYRKP TSNECIESRTKNEPP LCNGLDDANSTWN VTLQACMHKVPTD MSERGSQWPENWL HRLGKPPYWLNKV AVN | 791 | 69% (152/219) |
| 442 | Si/Si028042m | 51% (436/840) | 434-654 | VVLDVGCGVASFG GYLFDRDVLTMSL APKDEHEAQVQFA LERGIPAISAVMGT RRLPFPGGVFDVVH CARCRVPWHIDGG MLLLELNRLLRPGG VFVWSATPVYQKL PDDVEIWDEMAKL TKAMCWEMVAKT KHTVVDDQVGVAI FRKPERNGCYEKRP EKAPPLCEPSDDPN AAWNIKLRACMHR VPEDPSERGARWPE PWPERLGKAPYWL DGSQTGVY | 785 | 69% (154/221) |

TABLE 21-continued

Conserved 'Methyltransferase domain' of PMT24 and closely related sequences

| Col. 1 SEQ ID NO: | Col. 2 Species/ Identifier | Col. 3 Percent identity of polypeptide in Col. 1 to PMT24 | Col. 4 Methyltransferase domain in amino acid coordinates | Col. 5 Conserved methyltransferase domain | Col. 6 SEQ ID NO: of methyl-transferase domain | Col. 7 Percent identity of methyl-transferase domain in Col. 5 to methyl-transferase domain of PMT24 |
|---|---|---|---|---|---|---|
| 432 | Os/LOC_Os04g59590.1 | 65% (393/599) | 275-493 | VVLDVGCGVASFG GYLFDRDVLTMSF APKDEHEAQVQFA LERGIPAMSAVMG TKRLPFPGRVFDVV HCARCRVPWHIEG GKLLLELDRLLRPG GYFVWSATPVYQK LPEDVEIWEAMSTL TRSMCWEMVNKV KDRVNRVGIAIFRK PTDNSCYEARSAA NPPICGEYDDPDAA WNISLQSCVHRLPT DPAIRGSQWPVEW PLRLEKPPYWLKNS EAGVY | 780 | 68% (151/219) |
| 436 | Si/Si021320m | 55% (432/776) | 337-555 | VVLDVGCGVASFG GYLFDRDVITMSFA PKDEHEAQVQFAL ERGIPAISAVMGTK RLPFPSRVFDVVHC ARCRVPWHIEGGK LLLELDRLLRPGGY FVWSATPVYQKLP EDVEIWEAMSALT RSMCWKMVNKVK DRVNRVGIAIFRKP TDNSCYEERSEANS PICGEYDDPDAAW NVSLRTCMHKLPV DLTIRGSKWPELWP LRLEKPPYWLKSSE AGVY | 782 | 68% (150/219) |

These functionally-related and/or closely-related PMT24 clade polypeptides may be identified by a consensus methyltransferase domain sequence, SEQ ID NO: 861:

VX$^2$LDVGCGVASFGGX$^{15}$X$^{16}$FX$^{18}$X$^{19}$X$^{20}$X$^{21}$X$^{22}$X$^{23}$X$^{24}$SX$^{26}$APK

DX$^{31}$HEAQVQFALERGIPAX$^{47}$X$^{48}$X$^{49}$VMGTX$^{54}$RLPX$^{58}$PX$^{60}$X$^{61}$VF

DX$^{65}$X$^{66}$HCARCRVPWHX$^{77}$X$^{78}$GGX$^{81}$LLLELX$^{87}$RX$^{89}$LRPGGX$^{95}$F

X$^{97}$WSATPX$^{103}$YX$^{105}$X$^{106}$X$^{107}$X$^{108}$X$^{109}$X$^{110}$X$^{111}$X$^{112}$IW

X$^{115}$X$^{116}$MX$^{118}$X$^{119}$X$^{120}$X$^{121}$X$^{122}$X$^{123}$MCWX$^{127}$X$^{128}$X$^{129}$

X$^{130}$X$^{131}$X$^{132}$X$^{133}$X$^{134}$X$^{135}$X$^{136}$X$^{137}$X$^{138}$X$^{139}$X$^{140}$VX$^{142}$

X$^{143}$X$^{144}$X$^{145}$X$^{146}$X$^{147}$KPX$^{150}$X$^{151}$NX$^{153}$CYX$^{156}$X$^{157}$RX$^{159}$

X$^{160}$X$^{161}$X$^{162}$X$^{163}$X$^{164}$X$^{165}$CX$^{167}$X$^{168}$X$^{169}$DX$^{171}$X$^{172}$X$^{173}$

X$^{174}$X$^{175}$WX$^{177}$X$^{178}$X$^{179}$LX$^{181}$X$^{182}$CX$^{184}$HX$^{186}$X$^{187}$X$^{188}$

X$^{189}$X$^{190}$X$^{191}$X$^{192}$X$^{193}$X$^{194}$RX$^{196}$X$^{197}$X$^{198}$X$^{199}$PX$^{201}$X$^{202}$

-continued

WPX$^{205}$RX$^{207}$X$^{208}$X$^{209}$X$^{210}$PX$^{212}$WX$^{214}$X$^{215}$X$^{216}$SX$^{218}$X$^{219}$

GX$^{221}$Y where X$^2$=any amino acid; X$^{15}$=F or Y; X$^{16}$=I, L, V or M; X$^{18}$=D or E; X$^{19}$=H, K or R; X$^{20}$=D or G; X$^{21}$=any amino acid; X$^{22}$=I, L, V or M; X$^{23}$=A or T; X$^{24}$=I, L, V or M; X$^{26}$=F, I, L, V or M; X$^{31}$=any amino acid; X$^{47}$=T, I, L, V or M; X$^{48}$=any amino acid; X$^{49}$=any amino acid; X$^{54}$=I, L, V or M; X$^{58}$=F or Y; X$^{60}$=A, S or G; X$^{61}$=any amino acid; X$^{65}$=I, L, V or M; X$^{66}$=I, L, V or M; X$^{77}$=I, L, V or M; X$^{78}$=D or E; X$^{81}$=any amino acid; X$^{87}$=N or D; X$^{89}$=A, I, L, V or M; X$^{95}$=any amino acid; X$^{97}$=I, L, V or M; X$^{103}$=A, I, L, V, or M; X$^{105}$=Q or R; X$^{106}$=any amino acid; X$^{107}$=any amino acid; X$^{108}$=any amino acid; X$^{109}$=D or E; X$^{110}$=D or N; X$^{111}$=any amino acid; X$^{112}$=any amino acid; X$^{115}$=any amino acid; X$^{116}$=any amino acid; X$^{118}$=any amino acid; X$^{119}$=any amino acid; X$^{120}$=I, L, V or M; X$^{121}$=T, I, L, V or M; X$^{122}$=any amino acid; X$^{123}$=any amino acid; X$^{127}$=any amino acid; X$^{128}$=I, L, V or M; X$^{129}$=I, L, V or M; X$^{130}$=any amino acid; X$^{131}$=any amino acid; X$^{132}$=any amino acid; X$^{133}$=any amino acid; X$^{134}$=H, D; X$^{135}$=any amino acid;

$X^{136}$=I, L, V or M; $X^{137}$=V or absent; $X^{138}$=D or absent; $X^{139}$=I, L, V or M; $X^{140}$=any amino acid; $X^{142}$=A or G; $X^{143}$=any amino acid; $X^{144}$=any amino acid; $X^{145}$=T, I, L, V or M; $X^{146}$=F or Y; $X^{147}$=Q, R or K; $X^{150}$=any amino acid; $X^{151}$=any amino acid; $X^{153}$=any amino acid; $X^{156}$=any amino acid; $X^{157}$=any amino acid; $X^{159}$=any amino acid; $X^{160}$=any amino acid; $X^{161}$=any amino acid; $X^{162}$=any amino acid; $X^{163}$=any amino acid; $X^{164}$=S or P; $X^{165}$=I, L, V or M; $X^{167}$=any amino acid; $X^{168}$=any amino acid; $X^{169}$=any amino acid; $X^{171}$=N or D; $X^{172}$=any amino acid; $X^{173}$=N or D; $X^{174}$=A or T; $X^{175}$=A or S; $X^{177}$=any amino acid; $X^{178}$=I, L, V or M; $X^{179}$=any amino acid; $X^{181}$=any amino acid; $X^{182}$=A, S or T; $X^{184}$=I, L, V or M; $X^{186}$=any amino acid; $X^{187}$=A, I, L, V or M; $X^{188}$=any amino acid; $X^{189}$=any amino acid; $X^{190}$=any amino acid; $X^{191}$=Y or absent; $X^{192}$=any amino acid; $X^{193}$=any amino acid; $X^{194}$=any amino acid; $X^{196}$=S or G; $X^{197}$=S or A; $X^{198}$=any amino acid; $X^{199}$=any amino acid; $X^{201}$=any amino acid; $X^{202}$=any amino acid; $X^{205}$=any amino acid; $X^{207}$=any amino acid; $X^{208}$=any amino acid; $X^{209}$=any amino acid; $X^{210}$=any amino acid; $X^{212}$=any amino acid; $X^{214}$=I, L, V or M; $X^{215}$=any amino acid; $X^{216}$=any amino acid or absent; $X^{218}$=K, E, H or Q; $X^{219}$=any amino acid; and $X^{221}$=I, L, V or M.

Alternative consensus sequences comprising the above with conservative substitutions found in the instant Tables are also envisaged and may be expected to provide equivalent function(s).

The presence of one or more of these consensus sequences and/or these amino acid residues is correlated with conferring of improved or increased photosynthetic resource use efficiency to a plant when the expression level of the polypeptide is altered in a plant by being reduced, knocked-out, or overexpressed. An AtMYB27, RBP45A, TCP6, PILL PCL1, GTL1, DREB2H, ERF087, NF-YC6, BBX18, bHLH60, BBX26, bHLH121, or PMT24 clade polypeptide sequence that is "functionally-related and/or closely-related" to the listed full length protein sequences or domains provided in the instant Tables may also have, to any of the listed sequences found in the Sequence Listing or to the entire length of a listed sequence, at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% amino acid identity to any of SEQ ID NOs: 2, 42, 86, 108, 126, 156, 192, 246, 278, 318, 356, 388, 410, 444 or SEQ ID NOs: 2n where n=1 to 241, and/or at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% amino acid identity to a domain of any of SEQ ID NOs: 483, 490, 510, 538, 566, 588, 599, 608, 623, 629, 659, 686, 702, 721, 741, 760, 769, 786, 813, and/or at least 90%, 91%, 92%, 93%, 94%, 95%, 96%, 97%, 98%, 99%, or about 100% identity to any of consensus sequences SEQ ID NOs: 842-861. The presence of the listed domains in a listed polypeptide sequence is correlated with the conferring of improved or increased photosynthetic resource use efficiency to a plant when the expression level of the polypeptide is altered in a plant by being reduced, knocked-out, or overexpressed. All of the sequences that adhere to these functional and sequential relationships are herein referred to as AtMYB27, RBP45A, TCP6, PILL PCL1, GTL1, DREB2H, ERF087, NF-YC6, BBX18, bHLH60, BBX26, bHLH121, or PMT24 clade polypeptides, or which fall within the AtMYB27, RBP45A, TCP6, PILL PCL1, GTL1, DREB2H, ERF087, NF-YC6, BBX18, bHLH60, BBX26, bHLH121, or PMT24 clade exemplified in the phylogenetic trees presented in the Figures.

Example II. Plant Genotypes and Vector and Cloning Information

A variety of constructs may be used to modulate the activity of regulatory polypeptides (RPs), and to test the activity of orthologs and paralogs in transgenic plant material. This platform provides the material for all subsequent analysis.

An individual plant "genotype" refers to a set of plant lines containing a particular construct or knockout (for example, this might be 35S lines for a given gene sequence (GID, Gene Identifier) being tested, 35S lines for a paralog or ortholog of that gene sequence, lines for an RNAi construct, lines for a GAL4 fusion construct, or lines in which expression of the gene sequence is driven from a particular promoter that enhances expression in particular cell, tissue or condition). For a given genotype arising from a particular transformed construct, multiple independent transgenic lines may be examined for morphological and physiological phenotypes. Each individual "line" (also sometimes known as an "event") refers to the progeny plant or plants deriving from the stable integration of the transgene(s), carried within the T-DNA borders contained within a transformation construct, into a specific location or locations within the genome of the original transformed cell. It is well known in the art that different lines deriving from transformation with a given transgene may exhibit different levels of expression of that transgene due to so called "position effects" of the surrounding chromatin at the locus of integration in the genome, and therefore it is necessary to examine multiple lines containing each construct of interest.

(1) Overexpression/Tissue-Enhanced/Conditional Expression.

Expression of a given regulatory protein from a particular promoter, for example a photosynthetic tissue-enhanced promoter (e.g., a green tissue- or leaf-enhanced promoter), is achieved either by a direct-promoter fusion construct in which that regulatory protein is cloned directly behind the promoter of interest or by a two component system.

The Two-Component Expression System.

For the two-component system, two separate constructs are used: Promoter::LexA-GAL4TA and opLexA::RP. The first of these (Promoter::LexA-GAL4TA) comprises a desired promoter cloned in front of a LexA DNA binding domain fused to a GAL4 activation domain. The construct vector backbone (pMEN48, also known as P5375) also carries a kanamycin resistance marker, along with an opLexA::GFP (green fluorescent protein) reporter. Transgenic lines are obtained containing this first component, and a line is selected that shows reproducible expression of the reporter gene in the desired pattern through a number of generations. A homozygous population is established for that line, and the population is supertransformed with the second construct (opLexA::RP) carrying the regulatory protein of interest cloned behind a LexA operator site. This second construct vector backbone (pMEN53, also known as P5381) also contains a sulfonamide resistance marker.

Conditional Expression.

Various promoters can be used to overexpress disclosed polypeptides in plants to confer improved photosynthetic resource use efficiency. However, in some cases, there may be limitations in the use of various proteins that confer increased photosynthetic resource use efficiency when the proteins are overexpressed. Negative side effects associated with constitutive overexpression such as small size, delayed growth, increased disease sensitivity, and development and alteration in flowering time are not uncommon A number of stress-inducible promoters can be used promote protein expression during the periods of stress, and therefore may be used to induce overexpression of polypeptides that can confer improved stress tolerance when they are needed without the adverse developmental or morphological effects that may be associated with their constitutive overexpression.

Promoters that drive protein expression in response to stress can be used to regulate the expression of the disclosed polypeptides to confer photosynthetic resource use efficiency to plants. The promoter may regulate expression of a disclosed polypeptide to an effective level in a photosynthetic tissue. Effective level in this regard refers to an expression level that confers greater photosynthetic resource use efficiency in the transgenic plant relative to the control plant that, for example, does not comprise a recombinant polynucleotide that encodes the disclosed polypeptide. Optionally, the promoter does not regulate protein expression in a constitutive manner.

Such promoters include, but are not limited to, the sequences located in the promoter regions of At5g52310 (RD29A), At5g52300, AT1G16850, At3g46230, AT1G52690, At2g37870, AT5G43840, At5g66780, At3g17520, and At4g09600.

In addition, promoters with expression specific to or enhanced in particular cells or tissue types may be used to express a given regulatory protein only in these cells or tissues. Examples of such promoter types include but are not limited to promoters expressed in green tissue, guard cell, epidermis, whole root, root hairs, vasculature, apical meristems, and developing leaves.

Table 22 lists a number of photosynthetic tissue-enhanced promoters, specifically, mesophyll tissue-enhanced promoters from rice, that may be used to regulate expression of polynucleotides and polypeptides found in the Sequence Listing and structurally and functionally-related sequences. Promoters that may be used to drive expression of polynucleotides and polypeptides found in the Sequence Listing and structurally and functionally-related sequences included, but are not limited to, promoter sequences SEQ ID NO: 862-864 and the following promoters listed in Table 22, as well as promoters that are at least 80%, 81%, 82%, 83%, 84%, 85%, 86%, 87%, 88%, 89%, 90%, 91%, 92%, 93%, 94%, 95% or 96%, 97%, 98%, 99%, or about 100% identical to SEQ ID NO: 862-888, or comprise a functional fragment of promoters that are at least 80%, 81%, 82%, 83%, 84%, 85%, 86%, 87%, 88%, 89%, 90%, 91%, 92%, 93%, 94%, 95% or 96%, 97%, 98%, 99%, or about 100% identical to SEQ ID NO: 862-888.

TABLE 22

Rice Genes with Photosynthetic Tissue-Enhanced Promoters

| SEQ ID NO: | Rice Gene Identifier of Photosynthetic Tissue-Enhanced Promoter |
|---|---|
| 865 | Os02g09720 |
| 866 | Os05g34510 |
| 867 | Os11g08230 |
| 868 | Os01g64390 |
| 869 | Os06g15760 |
| 870 | Os12g37560 |
| 871 | Os03g17420 |
| 872 | Os04g51000 |
| 873 | Os01g01960 |
| 874 | Os05g04990 |
| 875 | Os02g44970 |
| 876 | Os01g25530 |
| 877 | Os03g30650 |
| 878 | Os01g64910 |
| 879 | Os07g26810 |
| 880 | Os07g26820 |
| 881 | Os09g11220 |
| 882 | Os04g21800 |
| 883 | Os10g23840 |
| 884 | Os08g13850 |
| 885 | Os12g42980 |
| 886 | Os03g29280 |
| 887 | Os03g20650 |
| 888 | Os06g43920 |

Tissue-enhanced promoters that may be used to drive expression of polynucleotides and polypeptides found in the Sequence Listing and structurally and functionally-related sequences have also been described in U.S. patent publication no. 20110179520A1, incorporated herein by reference. Such promoters include, but are not limited to, Arabidopsis sequences located in the promoter regions of AT1G08465, AT1G10155, AT1G14190, AT1G24130, AT1G24735, AT1G29270, AT1G30950, AT1G31310, AT1G37140, AT1G49320, AT1G49475, AT1G52100, AT1G60540, AT1G60630, AT1G64625, AT1G65150, AT1G68480, AT1G68780, AT1G69180, AT1G77145, AT1G80580, AT2G03500, AT2G17950, AT2G19910, AT2G27250, AT2G33880, AT2G39850, AT3G02500, AT3G12750, AT3G15170, AT3G16340, AT3G27920, AT3G30340, AT3G42670, AT3G44970, AT3G49950, AT3G50870, AT3G54990, AT3G59270, AT4G00180, AT4G00480, AT4G12450, AT4G14819, AT4G31610, AT4G31615, AT4G31620, AT4G31805, AT4G31877, AT4G36060, AT4G36470, AT4G36850, AT4G37970, AT5G03840, AT5G12330, AT5G14070, AT5G16410, AT5G20740, AT5G27690, AT5G35770, AT5G39330, AT5G42655, AT5G53210, AT5G56530, AT5G58780, AT5G61070, and AT5G6491.

In addition to the sequences provided in the Sequence Listing or in this Example, a promoter region may include a fragment of the promoter sequences provided in the Sequence Listing or in this Example, or a complement thereof, wherein the promoter sequence, or the fragment thereof, or the complement thereof, regulates expression of a polypeptide in a plant cell, for example, in response to a biotic or abiotic stress, or in a manner that is enhanced or preferred in certain plant tissues.

(2) Knock-Out/Knock-Down

In some cases, lines mutated in a given regulatory protein may be analyzed. Where available, T-DNA insertion lines in a given gene are isolated and characterized. In cases where a T-DNA insertion line is unavailable, an RNA interference (RNAi) strategy is sometimes used.

Example III. Transformation Methods

Crop species that overexpress polypeptides of the instant description may produce plants with increased photosynthetic resource use efficiency and/or yield. Thus, polynucleotide sequences listed in the Sequence Listing recombined into, for example, one of the expression vectors of the instant description, or another suitable expression vector, may be transformed into a plant for the purpose of modifying plant traits for the purpose of improving yield, quality, and/or photosynthetic resource use efficiency. The expression vector may contain a constitutive, tissue-enhanced or inducible promoter operably linked to the polynucleotide. The cloning vector may be introduced into a variety of plants by means well known in the art such as, for example, direct DNA transfer or *Agrobacterium tumefaciens*-mediated transformation.

Transformation of Monocots.

Cereal plants including corn, wheat, rice, sorghum, barley, or other monocots may be transformed with the present polynucleotide sequences, including monocot or eudicot-derived sequences such as those presented in the present Tables, cloned into a vector such as pGA643 and containing a kanamycin-resistance marker, and expressed constitutively under, for example, the CaMV35S or COR15 promoters, or with tissue-enhanced or inducible promoters. The expression vectors may be one found in the Sequence Listing, or any other suitable expression vector may be similarly used. For example, pMEN020 may be modified to replace the NptII coding region with the BAR gene of *Streptomyces hygroscopicus* that confers resistance to phosphinothricin. The KpnI and BglII sites of the Bar gene are removed by site-directed mutagenesis with silent codon changes.

The cloning vector may be introduced into a variety of cereal plants by means well known in the art including direct DNA transfer or *Agrobacterium tumefaciens*-mediated transformation. The latter approach may be accomplished by a variety of means, including, for example, that of U.S. Pat. No. 5,591,616, in which monocotyledon callus is transformed by contacting dedifferentiating tissue with the *Agrobacterium* containing the cloning vector.

The sample tissues are immersed in a suspension of $3 \times 10^{-9}$ cells of *Agrobacterium* containing the cloning vector for 3-10 minutes. The callus material is cultured on solid medium at 25° C. in the dark for several days. The calli grown on this medium are transferred to a Regeneration Medium. Transfers are continued every two to three weeks (two or three times) until shoots develop. Shoots are then transferred to Shoot-Elongation Medium every 2-3 weeks. Healthy looking shoots are transferred to Rooting Medium and after roots have developed, the plants are placed into moist potting soil.

The transformed plants are then analyzed for the presence of the NPTII gene/kanamycin resistance by ELISA, using the ELISA NPTII kit from SPrime-3Prime Inc. (Boulder, Colo.).

It is also routine to use other methods to produce transgenic plants of most cereal crops (Vasil, 1994. *Plant Mol. Biol.* 25: 925-937) such as corn, wheat, rice, sorghum (Cassas et al., 1993. *Proc. Natl. Acad. Sci. USA* 90: 11212-11216), and barley (Wan and Lemeaux, 1994. *Plant Physiol.* 104: 37-48). DNA transfer methods such as the microprojectile method can be used for corn (Fromm et al., 1990. *Bio/Technol.* 8: 833-839; Gordon-Kamm et al., 1990. *Plant Cell* 2: 603-618; Ishida, 1990. *Nature Biotechnol.* 14:745-750), wheat (Vasil et al., 1992. *Bio/Technol.* 10:667-674; Vasil et al., 1993. *Bio/Technol.* 11:1553-1558; Weeks et al., 1993. *Plant Physiol.* 102:1077-1084), and rice (Christou, 1991. *Bio/Technol.* 9:957-962; Hiei et al., 1994. *Plant J.* 6:271-282; Aldemita and Hodges, 1996. *Planta* 199: 612-617; and Hiei et al., 1997. *Plant Mol. Biol.* 35:205-218). For most cereal plants, embryogenic cells derived from immature scutellum tissues are the preferred cellular targets for transformation (Hiei et al., 1997. supra; Vasil, 1994. supra). For transforming corn embryogenic cells derived from immature scutellar tissue using microprojectile bombardment, the A188XB73 genotype is the preferred genotype (Fromm et al., 1990. *Bio/Technol.* 8: 833-839; Gordon-Kamm et al., 1990. supra). After microprojectile bombardment the tissues are selected on phosphinothricin to identify the transgenic embryogenic cells (Gordon-Kamm et al., 1990. supra). Transgenic plants from transformed host plant cells may be regenerated by standard corn regeneration techniques (Fromm et al., 1990. *Bio/Technol.* 8: 833-839; Gordon-Kamm et al., 1990. supra).

Transformation of Dicots.

It is now routine to produce transgenic plants using most eudicot plants (see U.S. Pat. No. 8,273,954 (Rogers et al.) issued Sep. 25, 2012; Weissbach and Weissbach, 1989. *Methods for Plant Molecular Biology*, Academic Press; Gelvin et al., 1990. *Plant Molecular Biology Manual*, Kluwer Academic Publishers; Herrera-Estrella et al., 1983. *Nature* 303: 209; Bevan, 1984. *Nucleic Acids Res.* 12: 8711-8721; and Klee, 1985. *Bio/Technology* 3: 637-642). Methods for analysis of traits are routine in the art and examples are disclosed above.

Numerous protocols for the transformation of tomato and soy plants have been previously described, and are well known in the art. Gruber et al., in Glick and Thompson, 1993. *Methods in Plant Molecular Biology and Biotechnology.* eds., CRC Press, Inc., Boca Raton, describe several expression vectors and culture methods that may be used for cell or tissue transformation and subsequent regeneration. For soybean transformation, methods are described by Miki et al., 1993. in *Methods in Plant Molecular Biology and Biotechnology*, p. 67-88, Glick and Thompson, eds., CRC Press, Inc., Boca Raton; and U.S. Pat. No. 5,563,055, (Townsend and Thomas), issued Oct. 8, 1996.

There are a substantial number of alternatives to *Agrobacterium*-mediated transformation protocols, other methods for the purpose of transferring exogenous genes into soybeans or tomatoes. One such method is microprojectile-mediated transformation, in which DNA on the surface of microprojectile particles is driven into plant tissues with a biolistic device (see, for example, Sanford et al., 1987. *Part. Sci. Technol.* 5:27-37; Sanford, 1993. *Methods Enzymol.* 217: 483-509; Christou et al., 1992. *Plant. J.* 2: 275-281; Klein et al., 1987. *Nature* 327: 70-73; U.S. Pat. No. 5,015,580 (Christou et al), issued May 14, 1991; and U.S. Pat. No. 5,322,783 (Tomes et al.), issued Jun. 21, 1994).

Alternatively, sonication methods (see, for example, Zhang et al., 1991. *Bio/Technology* 9: 996-997); direct uptake of DNA into protoplasts using $CaCl_2$ precipitation, polyvinyl alcohol or poly-L-ornithine (see, for example, Hain et al., 1985. *Mol. Gen. Genet.* 199: 161-168; Draper et al., 1982. *Plant Cell Physiol.* 23: 451-458); liposome or spheroplast fusion (see, for example, Deshayes et al., 1985. *EMBO J.*, 4: 2731-2737; Christou et al., 1987. *Proc. Natl. Acad. Sci. USA* 84: 3962-3966); and electroporation of protoplasts and whole cells and tissues (see, for example, Donn et al. 1990. in *Abstracts of VIIth International Congress on Plant Cell and Tissue Culture IAPTC*, A2-38: 53; D'Halluin et al., 1992. *Plant Cell* 4: 1495-1505; and Spencer et al., 1994. *Plant Mol. Biol.* 24: 51-61) have been used to introduce foreign DNA and expression vectors into plants.

After a plant or plant cell is transformed (and the transformed host plant cell then regenerated into a plant), the transformed plant may propagated vegetatively or it may be crossed with itself or a plant from the same line, a non-transformed or wild-type plant, or another transformed plant from a different transgenic line of plants. Crossing provides the advantages of producing new and often stable transgenic varieties. Genes and the traits they confer that have been introduced into a tomato or soybean line may be moved into distinct line of plants using traditional backcrossing techniques well known in the art. Transformation of tomato plants may be conducted using the protocols of Koornneef et al, 1986. In *Tomato Biotechnology*: Alan R. Liss, Inc., 169-178, and in U.S. Pat. No. 6,613,962, the latter method described in brief here. Eight day old cotyledon explants are precultured for 24 hours in Petri dishes containing a feeder layer of *Petunia hybrida* suspension cells plated on MS medium with 2% (w/v) sucrose and 0.8% agar supplemented with 10 µM α-naphthalene acetic acid and 4.4 µM 6-benzylaminopurine. The explants are then infected with a diluted overnight culture of *Agrobacterium tumefaciens* containing an expression vector comprising a polynucleotide of the instant description for 5-10 minutes, blotted dry on sterile filter paper and cocultured for 48 hours on the original feeder layer plates. Culture conditions are as described above. Overnight cultures of *Agrobacterium tumefaciens* are diluted in liquid MS medium with 2% (w/v/) sucrose, pH 5.7, to an $OD_{600}$ of 0.8.

Following cocultivation, the cotyledon explants are transferred to Petri dishes with selective medium comprising MS medium with 4.56 µM zeatin, 67.3 µM vancomycin, 418.9 µM cefotaxime and 171.6 µM kanamycin sulfate, and cultured under the culture conditions described above. The explants are subcultured every three weeks onto fresh medium. Emerging shoots are dissected from the underlying callus and transferred to glass jars with selective medium without zeatin to form roots. The formation of roots in a kanamycin sulfate-containing medium is a positive indication of a successful transformation.

Transformation of soybean plants may be conducted using the methods found in, for example, U.S. Pat. No. 5,563,055 (Townsend et al., issued Oct. 8, 1996), described in brief here. In this method soybean seed is surface sterilized by exposure to chlorine gas evolved in a glass bell jar. Seeds are germinated by plating on 1/10 strength agar solidified medium without plant growth regulators and culturing at 28° C. with a 16 hour day length. After three or four days, seed may be prepared for cocultivation. The seedcoat is removed and the elongating radicle removed 3-4 mm below the cotyledons.

*Eucalyptus* is now considered an important crop that is grown for example to provide feedstocks for the pulp and paper and biofuel markets. This species is also amenable to transformation as described in PCT patent publication WO/2005/032241.

*Crambe* has been recognized as a high potential oilseed crop that may be grown for the production of high value oils. An efficient method for transformation of this species has been described in PCT patent publication WO 2009/067398 A1.

Overnight cultures of *Agrobacterium tumefaciens* harboring the expression vector comprising a polynucleotide of the instant description are grown to log phase, pooled, and concentrated by centrifugation. Inoculations are conducted in batches such that each plate of seed was treated with a newly resuspended pellet of *Agrobacterium*. The pellets are resuspended in 20 ml inoculation medium. The inoculum is poured into a Petri dish containing prepared seed and the cotyledonary nodes are macerated with a surgical blade. After 30 minutes the explants are transferred to plates of the same medium that has been solidified. Explants are embedded with the adaxial side up and level with the surface of the medium and cultured at 22° C. for three days under white fluorescent light. These plants may then be regenerated according to methods well established in the art, such as by moving the explants after three days to a liquid counter-selection medium (see U.S. Pat. No. 5,563,055).

The explants may then be picked, embedded and cultured in solidified selection medium. After one month on selective media transformed tissue becomes visible as green sectors of regenerating tissue against a background of bleached, less healthy tissue. Explants with green sectors are transferred to an elongation medium. Culture is continued on this medium with transfers to fresh plates every two weeks. When shoots are 0.5 cm in length they may be excised at the base and placed in a rooting medium.

Experimental Methods; Transformation of *Arabidopsis*.

Transformation of *Arabidopsis* is performed by an *Agrobacterium*-mediated protocol based on the method of Bechtold and Pelletier, 1998. Unless otherwise specified, all experimental work is performed using the Columbia ecotype.

Plant Preparation.

*Arabidopsis* seeds are gas sterilized and sown on plates with media containing 80% MS with vitamins, 0.3% sucrose and 1% Bacto™ agar. The plates are placed at 4° in the dark for the days then transferred to 24 hour light at 22° for 7 days. After 7 days the seedlings are transplanted to soil, placing individual seedlings in each pot. The primary bolts are cut off a week before transformation to break apical dominance and encourage auxiliary shoots to form. Transformation is typically performed at 4-5 weeks after sowing.

Bacterial Culture Preparation.

*Agrobacterium* stocks are inoculated from single colony plates or from glycerol stocks and grown with the appropriate antibiotics until saturation. On the morning of transformation, the saturated cultures are centrifuged and bacterial pellets are re-suspended in Infiltration Media (0.5×MS, 1× Gamborg's Vitamins, 5% sucrose, 200 µl/L Silwet® L77) until an $A_{600}$ reading of 0.8 is reached.

Transformation and Harvest of Transgenic Seeds.

The *Agrobacterium* solution is poured into dipping containers. All flower buds and rosette leaves of the plants are immersed in this solution for 30 seconds. The plants are laid on their side and wrapped to keep the humidity high. The plants are kept this way overnight at 22° C. and then the pots are turned upright, unwrapped, and moved to the growth racks. In most cases, the transformation process is repeated one week later to increase transformation efficiency.

The plants are maintained on the growth rack under 24-hour light until seeds are ready to be harvested. Seeds are harvested when 80% of the siliques of the transformed plants are ripe (approximately five weeks after the initial transformation). This seed is deemed $T_0$ seed, since it is obtained from the $T_0$ generation, and is later plated on selection plates (either kanamycin or sulfonamide). Resistant plants that are identified on such selection plates comprise the T1 generation, from which transgenic seed comprising an expression vector of interest may be derived.

Example IV. Primary Screening Materials and Methods

Plant Growth Conditions.

Seeds from *Arabidopsis* lines are chlorine gas sterilized using a standard protocol and spread onto plates containing a sucrose-based media augmented with vitamins (80% MS+Vit, 1% sucrose, 0.65% PhytoBlend™ Agar; Caisson Laboratories, Inc., North Logan, Utah) and appropriate kanamycin or sulfonamide concentrations where selection is required. Seeds are stratified in the dark on plates, at 4° C. for 3 days then moved to a walk-in growth chamber (Conviron MTW120, Conviron Controlled Environments Ltd, Winnipeg, Manitoba, Canada) running at a 10 hour photoperiod at a photosynthetic photon flux of approximately 200 $\mu$mol m$^{-2}$ s$^{-1}$ at plant height and a photoperiod/night temperature regime of 22° C./19° C. After seven days of light exposure seedlings are transplanted into 164 ml volume pots containing autoclaved ProMix® soil. All pots are returned to the same growth-chamber where they are stood in water and covered with a lid for the first seven days. This protocol keeps the soil moist during this period. Seven days after transplanting lids are removed and a watering and nutrition regime begun. All plants receive water three times a week, and a weekly a fertilizer treatment (80% Peter's NPK fertilizer).

Primary Screening.

Between 35 and 38 days after being transferred to lighted conditions on plates, and after between 28 and 31 days growth in soil, a suite of leaf-physiological parameters are measured using an infrared gas analyzer (LI-6400XT, LI-COR® Biosciences, Lincoln, Nebr., USA) integrated with a fluorimeter that measures fluorescence from Chlorophyll A (LI-6400-40, LI-COR Biosciences). This technique involves clamping a leaf between two gaskets, effectively sealing it inside a chamber, then measuring the exchange of carbon dioxide and water vapor between the leaf and the air flowing through the chamber. This gas exchange is monitored simultaneously with the fluorescence levels from the chlorophyll a molecules in the leaf. The growth conditions used, and plant age and leaf selection criteria for measurement are designed to maximize the chance that the leaves sampled fill the 2 cm$^2$ leaf chamber of the gas-exchange system and that plants show no visible signs of having transitioned to reproductive growth.

Screening High-Light Leaf Physiology at Two Air Temperatures.

Leaf physiology is screened after plants have been acclimated to high light (700 $\mu$mol photons m$^{-2}$ s$^{-1}$) under LED light banks emitting visible light (400-700 nm, Photon Systems Instruments, Brno, Czech Republic), for 40 minutes. Other than the change in light level, the atmospheric environment is the same as that in which the plants have been grown, and the LI-6400 leaf chamber is set to reflect this, being set to deliver a photosynthetic photon flux of 700 $\mu$mol photons m$^{-2}$ s$^{-1}$ and operate at an air temperature of 22° C. Forty minutes acclimation to a photosynthetic photon flux of 700 $\mu$mol photons m$^{-2}$ s$^{-1}$ has repeatedly been shown to be sufficient to achieve a steady-state rate of light-saturated photosynthesis and stomatal conductance in control plants. Gas exchange and fluorescence data are logged simultaneously two minutes after the leaf has been closed in the chamber. Two minutes is found to be long enough for the leaf chamber $CO_2$ and $H_2O$ concentrations to stabilize after closing a new leaf inside, and thereby minimizing leaf physiological adjustment to small differences between the growth environment and the LI-6400 chamber. Screening at the growth air temperature of 22° C. is begun one hour into the photoperiod and is typically completed in two hours. After being screened at 22° C., plants are returned to growth-light levels prior to being screened again at 35° C. later in the photoperiod. The higher-temperature screening begins six hours into the photoperiod and measurements are made after the rosettes have been acclimated to the same high light dose as described above, but this time in a controlled environment with an air temperature set to 35° C. Measurements are again made in a leaf chamber set to match the warmer air temperature and logged using the protocol described above for the 22° C. measurements. Data generated at both 22° C. and 35° C. are used to calculate: rates of $CO_2$ assimilation by photosynthesis (A, $\mu$mol $CO_2$ m$^{-2}$ s$^{-1}$); rates of $H_2O$ loss through transpiration (Tr, mmol $H_2O$ m$^{-2}$ s$^{-1}$); the conductance to $CO_2$ and $H_2O$ movement between the leaf and air through the stomatal pore ($g_s$, mol. $H_2O$ m$^{-2}$ s$^{-1}$); the sub-stomatal $CO_2$ concentration ($C_i$, $\mu$ml $CO_2$ mol$^{-1}$); transpiration efficiency, the instantaneous ratio of photosynthesis to transpiration, (TE=A/Tr ($\mu$mol $CO_2$ mmol $H_2O$ m$^{-2}$ s$^{-1}$)); the rate of electron flow through photosystem two (ETR e–m$^{-2}$ s$^{-1}$). Derivation of the parameters described above followed established published protocols (Long & Bernacchi, 2003. *J. Exp. Botany;* 54:2393-24)

Leaves from up to 10 replicate plants are screened for a given line of interest. Data generated from these lines are compared with that from an empty vector control line planted at the same time, grown within the same flats, and screened at the same time.

For control lines, data are collected not only at an atmospheric $CO_2$ concentration of 400 $\mu$mol $CO_2$ mol$^{-1}$, but also after stepwise changes in $CO_2$ concentration to 350, 300, 450 and 500 $\mu$mol $CO_2$ mol$^{-1}$. These measurements underlay screening for more complex physiological traits of: (1) photosynthetic capacity; (2) Non-photochemical quenching; and (3) non-photosynthetic metabolism.

Screening Photosynthetic Capacity.

Under most conditions, the rate of light-saturated photosynthesis in a C3 leaf is a product of the biochemical capacity of the Calvin cycle and the transfer conductance of $CO_2$ concentration to the sites of carboxylation (Farquhar et al., 1980. *Planta:* 149, 78-90). Plotting the rate of photosynthesis against an estimate of the sub-stomatal $CO_2$ concentration ($C_i$) provides a means to identify changes in photosynthetic capacity of the Calvin cycle independent of changes in stomatal conductance, a key component of the total transfer conductance to $CO_2$ of the leaf. Consequently, for lines being screened, rates of photosynthesis are plotted against a regression plot of A vs. $C_i$ generated for the control lines over a range of atmospheric $CO_2$ concentration, as described above. This technique enables visual confirmation of changes in photosynthetic capacity in lines of interest.

Screening Non-Photochemical Quenching.

During acclimation to high light, the efficiency with which photosystem PSII operates will reach a steady state regulated largely by the feedback between non-photochemical quenching (NPQ) in the antenna and the metabolic demand for energy produced in the chloroplast (Genty et al., 1989. *Biochim. Biophys. Acta* 990:87-92; Baker et al., 2007. *Plant Cell Environ.* 30:1107-1125). This understanding is used in this screen to identify lines in which the limitation that non-photochemical quenching exerts on the efficiency with which photosystem II operates is decreased or increased. A decrease in non-photochemical quenching may be the consequence of a decrease in the capacity for NPQ. This would result in lower levels of non-photochemical quenching and a higher efficiency of photosynthesis over a range of light levels, but importantly, higher rates of photosynthesis at low light where light-use efficiency is important. However, changes in rate at which NPQ responds to light could also underlie any increases or decreases in NPQ. Of these, an increase in the rate at which NPQ relaxes has the potential to increase rates of photosynthesis as leaves in crop canopies transition from high to low light, and is therefore relevant to increasing crop-canopy photosynthesis (Zhu et al., 2010. Plant Biol. 61:235-261). In keeping with the A/Ci analysis described above, a regression of the operating efficiency of PSII against non-photochemical quenching is generated for the control line from data collected over a range of atmospheric $CO_2$ concentration. This technique enables visual confirmation of changes in the regulation of PSII operation that are driven by changes in non-photochemical quenching in lines of interest.

Screening for Non-Photosynthetic Metabolism.

Measurement of the ratio of the rate of electron flow through PSII (ETR) to the rate of photosynthesis (A) is used to screen for changes in non-photosynthetic metabolism. This screen is based upon the understanding that the transport of four μmol of electrons from PSII to photosystem one PSI will supply the NADPH and ATP required to fix one μmol of $CO_2$ in the Calvin cycle. For a C3 leaf operating in an atmosphere with 21% oxygen, the ratio of electron flow to photosynthesis should be higher than four, reflecting photorespiratory and other metabolism. However, because the rate of photorespiration in a C3 leaf is dependent upon the concentration of $CO_2$ at the active site of Rubisco, a regression of the ratio of electron flow to photosynthesis, generated over the range of $CO_2$ concentrations described above, provides the reference regression against which lines being screened can be compared to controls. Changes in the ratio of ETR to A, when observed at the same $C_i$ as the control line, could indicate changes in the specificity of the Rubisco active site for $O_2$ relative to $CO_2$ and or other metabolic sinks which would be expected to have important implications for crop productivity and/or stress tolerance.

Surrogate Screening for Growth-Light Physiology.

Rosette biomass: the dry weight of whole *Arabidopsis* rosettes (i.e., above-ground biomass) is measured after being dried down at 80° C. for 24 hours, a time found to be sufficient to reach constant weight. Samples are taken after 35-38 days growth, and used as an assay of above-ground productivity at growth light. Typically, five replicate rosettes are sampled per *Arabidopsis* line being screened.

Rosette chemical and isotopic C and N analysis: after weighing, the five rosettes sampled for each line screened are pooled together and ground to a fine powder. The pooled sample generated is sub-sampled and approximately 4 μg samples are prepared for analysis.

Chlorophyll content index (CCI): measurements of light transmission through the leaf are made for plants being screened using a chlorophyll content meter (CCM-200, Apogee Instruments, Logan, Utah, USA). The first is made within the first hour of the photoperiod prior to any acclimation to high light on leaves of plants samples for rosette analysis. The second is made later in the photoperiod on leaves of plants that had undergone the high-temperature screening.

Light absorption: measurements of CCI are used as a surrogate for leaf light absorption, based upon a known relationship between the two. The estimates of light absorption by the leaf, required to construct this relationship, were made by placing the leaf on top of a quantum sensor (LI-190, LI-COR Biosciences) with both the leaf and quantum sensor then pressed firmly up to the foam gasket underneath the LI-6400 light source. This procedure provides an estimate of the transmission of a known light flux through the leaf and is used to estimate the fraction of light absorbed by the leaf.

Example V. Experimental Results

This Example provides experimental observations for transgenic plants overexpressing AtMYB27, RBP45A, TCP6, PILL PCL1, GTL1, DREB2H, ERF087, NF-YC6, BBX18, bHLH60, BBX26, bHLH121, or PMT24 related polypeptides assayed for improved photosynthetic resource use efficiency.

The ability of a crop canopy to photosynthesize, and the rate at which it can do this relative to the availability of resources, is an important determinant of crop yield. Consequently, increasing the rate of photosynthesis relative to resources that can limit productivity and yield is considered a pathway to improving crop yield across broad acres.

The biochemical capacity for photosynthesis is a key determinant of the efficiency with which photosynthesis operates relative to resources required for plant growth. The biochemical capacity for photosynthesis is the product of plant resource investment in numerous pigments and proteins required to absorb light and couple it to the enzymatic reduction of carbon in the air to sugars, in the chloroplast. This capacity for photosynthesis sets limits upon the rate of photosynthesis that can be achieved by a leaf, and ultimately the yield potential of crops. Consequently, increasing photosynthetic capacity is considered a pathway to improving crop yield across broad acres.

Tables 23-35 and the instant Figures provide evidence for improved photosynthetic resource use efficiency observed in *Arabidopsis* plants overexpressing AtMYB27, RBP45A, TCP6, PILL PCL1, GTL1, DREB2H, ERF087, NF-YC6, BBX18, bHLH60, BBX26, bHLH121, or PMT24 in experiments conducted to date. All experimental observations of greater photosynthetic resource use efficiency were made by comparison to control plants (e.g., plants that did not comprise a recombinant construct encoding an AtMYB27, RBP45A, TCP6, PILL PCL1, GTL1, DREB2H, ERF087, NF-YC6, BBX18, bHLH60, BBX26, bHLH121, or PMT24-related polypeptide or overexpress an AtMYB27, RBP45A, TCP6, PILL PCL1, GTL1, DREB2H, ERF087, NF-YC6, BBX18, bHLH60, BBX26, bHLH121, or PMT24 clade or phylogenetically-related regulatory protein). Where a numerical value was determined, the percentage increases (+%) or decreases (−%) relative to control plants are shown in parentheses.

Table 23 describes an increased capacity for photosynthesis and increased photosynthetic rate in five independent lines overexpressing AtMYB27. Table 23 describes increased photosynthesis in five out of six independent lines overexpressing MYB27. When averaged for these five MYB27 overexpression lines, photosynthetic rate was increased by 23%. Table 5 also details how for four of these MYB27 overexpression lines this increase in photosynthetic rate is clearly linked to an increase in capacity for photosynthesis. Of the numerous steps that can limit photosynthesis, the activity of Rubisco and the capacity to regenerate RuBP in the Calvin cycle are key constraints. FIGS. 3 and 4 display evidence of increases in both Rubisco activity and the capacity to regenerate RuBP in multiple MYB27 overexpression lines (Long & Bernacchi 2003 already cited above, describe the basis for assaying Rubisco activity and RuBP regeneration capacity). For lines 1, 2 and 6, both the activity of Rubisco and the capacity to regenerate RuBP were increased by MYB27 overexpression. For line 5, only an increase in the capacity for RuBP regeneration was observed. Photosynthetic resource use efficiency was also increased in five of the six lines assayed. When averaged for these five lines, the 23% increase in photosynthetic rate was observed in tandem with a smaller, 13% increase in the nitrogen content of the rosette tissue.

TABLE 23

Components of increased photosynthetic resource use efficiency in AtMYB27 overexpression lines. Effects and relative effect size are displayed for leaf photosynthetic rate (photosynthesis) and rosette nitrogen concentration (rosette [N]). Effects on photosynthetic capacity are also described and where known the biochemical basis for the effect is described as either due to effects on Rubisco activity (Rubisco) or the capacity to regenerate RuBP (RuBP).

| Polypeptide Sequence/ Line | SEQ ID NO: | Driver | Target | Photosynthesis | Photosynthetic Capacity | Rosette [N] |
|---|---|---|---|---|---|---|
| AtMYB27/ Line 1 | 2 | 35S::m35S::oEnh:LexA:GAL4_opLexA::GFP | opLexA::G1311 | Increased (43%) | Increased Rubisco and RuBP | Increased (25%) |
| AtMYB27/ Line 2 | 2 | 35S::m35S::oEnh:LexA:GAL4_opLexA::GFP | opLexA::G1311 | Increased (30%) | Increased Rubisco and RuBP | Increased (30%) |
| AtMYB27/ Line 3 | 2 | 35S::m35S::oEnh:LexA:GAL4_opLexA::GFP | opLexA::G1311 | No effect | No effect | No effect |
| AtMYB27/ Line 4 | 2 | 35S::m35S::oEnh:LexA:GAL4_opLexA::GFP | opLexA::G1311 | Increased (14%) | No effect | Increased (8%) |
| AtMYB27/ Line 5 | 2 | 35S::m35S::oEnh:LexA:GAL4_opLexA::GFP | opLexA::G1311 | Increased (8%) | Increased RuBP | No effect |
| AtMYB27/ Line 6 | 2 | 35S::m35S::oEnh:LexA:GAL4_opLexA::GFP | opLexA::G1311 | Increased (20%) | Increased Rubisco and RuBP | Increased (3%) |

The results presented in Table 23 were determined after screening six independent transgenic events. Lines 1 and 2 were screened twice and the effect size reported for a given parameter is the mean of the two screening runs. For both lines the direction of the effect was the same in both runs. Lines 3, 4, 5 and 6 were screened once.

Table 24 details indicators of photosynthetic resource use efficiency observed in *Arabidopsis* plants overexpressing RBP45A in experiments conducted to date. Table 24 describes increased photosynthesis in five out of six independent lines overexpressing RBP45A. When averaged for these six lines, photosynthetic rate was increased by 11% in the RBP45A overexpression lines. Leaf chlorophyll absorbs light energy utilized for photosynthesis, and was increased by 5% when average across all six lines. Rosette nitrogen content was reduced by 3% in the five lines for which it was measured. That photosynthesis is increased in RBP45A overexpression lines to a greater extent than the investment in chlorophyll, while rosette nitrogen content is decreased, provides evidence that RBP45A overexpression improves the efficiency with which photosynthesis operates relative to availability of the key resources of light and nitrogen.

The results presented in Table 24 were determined after screening six independent transgenic events. Photosynthetic rate and leaf chlorophyll were screened in two independent experiments for lines 1, and 3, and the effect size reported for is the mean of the two screening runs. The direction of the effect was the same in each screening run. Lines 2, 4, 5, and 6 were screened once. Rosette nitrogen data was collected in one experiment.

Table 25 details indicators of photosynthetic resource use efficiency observed in *Arabidopsis* plants overexpressing TCP6 in experiments conducted to date. Table 25 describes increased photosynthesis in eight independent lines overexpressing TCP6. When averaged for these eight lines, photosynthetic rate was increased by 14% in the TCP6 overexpression lines. Leaf chlorophyll absorbs light energy utilized for photosynthesis, and was increased by 17% across the eight lines studied. Leaf chlorophyll and photosynthetic enyzmes are a major sink for plant nitrogen. However, rosette nitrogen content increased by only 3% when averaged across the six lines for which data is available in Table 7. That photosynthesis and leaf chlorophyll content can be increased with negligible effects on rosette nitrogen content

TABLE 24

Components of increased photosynthetic resource use efficiency in RBP45A overexpression lines. Effects and relative effect size are displayed for leaf photosynthetic rate (photosynthesis), leaf chlorophyll content and rosette nitrogen concentration (rosette [N]).

| Polypeptide Sequence/ Line | SEQ ID NO: | Driver | Target | Photosynthesis | Leaf Chlorophyll | Rosette [N] |
|---|---|---|---|---|---|---|
| RBP45A/ Line 1 | 42 | 35S::m35S::oEnh:LexA:GAL4_opLexA::GFP | opLexA::G1940 | Increased (15%) | Increased (8%) | No effect (<1%) |
| RBP45A/ Line 2 | 42 | 35S::m35S::oEnh:LexA:GAL4_opLexA::GFP | opLexA::G1940 | Increased (12%) | Decreased (10%) | — |
| RBP45A/ Line 3 | 42 | 35S::m35S::oEnh:LexA:GAL4_opLexA::GFP | opLexA::G1940 | Increased (11%) | Increased (4%) | Decreased (3%) |
| RBP45A/ Line 4 | 42 | 35S::m35S::oEnh:LexA:GAL4_opLexA::GFP | opLexA::G1940 | Increased (14%) | Increased (16%) | Decreased (4%) |
| RBP45A/ Line 5 | 42 | 35S::m35S::oEnh:LexA:GAL4_opLexA::GFP | opLexA::G1940 | Increased (15%) | Decreased (1%) | Decreased (5%) |
| RBP45A/ Line 6 | 42 | 35S::m35S::oEnh:LexA:GAL4_opLexA::GFP | opLexA::G1940 | Decreased (3%) | Increased (11%) | Increased (1%) | is evidence that TCP6 overexpression improves the efficiency with which photosynthesis operates relative to nitrogen availability.

All experimental observations of greater photosynthetic resource use efficiency were made by comparison to control plants (e.g., plants that did not comprise a recombinant construct encoding a TCP6 related polypeptide or overexpress a TCP6 clade or phylogenetically-related regulatory protein). Where a numerical value was determined, the percentage increases (+%) or decreases (-%) relative to control plants are shown in parentheses.

pressing PIL1 When averaged for these six lines, photosynthetic rate was increased by 15% in the PIL1 overexpression lines. Leaf chlorophyll absorbs light energy utilized for photosynthesis, and was decreased by 2% across three lines for which data was collected. Rosette nitrogen content was increased by 1% in the same three lines. That photosynthesis could be increased in PIL1 overexpression lines while decreasing investment in chlorophyll and for a much smaller relative increase in nitrogen is evidence that PIL1 overex-

TABLE 25

Components of increased photosynthetic resource use efficiency in TCP6 overexpression lines. Effects and relative effect size are displayed for leaf photosynthetic rate (photosynthesis), leaf chlorophyll content and rosette nitrogen concentration (rosette [N]).

| Polypeptide Sequence/ Line | SEQ ID NO: | Driver | Target | Photosynthesis | Leaf Chlorophyll | Rosette [N] |
|---|---|---|---|---|---|---|
| TCP6/ Line 1 | 86 | 35S::m35S::oEnh:LexA:GAL4_opLexA::GFP | opLexA::G1936 | Increased (9%) | Increased (10%) | Increased (2%) |
| TCP6/ Line 2 | 86 | 35S::m35S::oEnh:LexA:GAL4_opLexA::GFP | opLexA::G1936 | Increased (14%) | Increased (15%) | Increased (4%) |
| TCP6/ Line 3 | 86 | 35S::m35S::oEnh:LexA:GAL4_opLexA::GFP | opLexA::G1936 | Increased (10%) | Increased (17%) | Increased (18%) |
| TCP6/ Line 4 | 86 | 35S::m35S::oEnh:LexA:GAL4_opLexA::GFP | opLexA::G1936 | Increased (19%) | Increased (14%) | Decreased (4%) |
| TCP6/ Line 5 | 86 | 35S::m35S::oEnh:LexA:GAL4_opLexA::GFP | opLexA::G1936 | Increased (20%) | Increased (10%) | No effect |
| TCP6/ Line 6 | 86 | 35S::m35S::oEnh:LexA:GAL4_opLexA::GFP | opLexA::G1936 | Increased (17%) | Increased (24%) | Decreased (4%) |
| TCP6/ Line 7 | 86 | 35S::m35S::oEnh:LexA:GAL4_opLexA::GFP | opLexA::G1936 | Increased (21%) | Increased (42%) | — |
| TCP6/ Line 8 | 86 | 35S::m35S::oEnh:LexA:GAL4_opLexA::GFP | opLexA::G1936 | Increased (3%) | Increased (6%) | — |

The results presented in Table 25 were determined after screening eight independent transgenic events. Lines 1, 2 and 3 were screened in three independent experiments and the effect size reported for a given parameter is the mean of the three screening runs. Lines 4, 5, 6, 7 and 8 were screened once.

Table 26 details indicators of photosynthetic resource use efficiency observed in Arabidopsis plants overexpressing PIL1 in experiments conducted to date. Table 26 describes increased photosynthesis in six independent lines overexpression improves the efficiency with which photosynthesis operates relative to availability of the key resources of light and nitrogen.

All experimental observations of greater photosynthetic resource use efficiency were made by comparison to control plants (e.g., plants that did not comprise a recombinant construct encoding a PIL1-related polypeptide or overexpress a PIL1 clade or phylogenetically-related regulatory protein). Where a numerical value was determined, the percentage increases (+%) or decreases (-%) relative to control plants are shown in parentheses.

TABLE 26

Components of increased photosynthetic resource use efficiency in PIL1 overexpression lines. Effects and relative effect size are displayed for leaf photosynthetic rate (photosynthesis), leaf chlorophyll content and rosette nitrogen concentration (rosette [N]).

| Polypeptide Sequence/ Line | SEQ ID NO: | Driver | Target | Photosynthesis | Leaf Chlorophyll | Rosette [N] |
|---|---|---|---|---|---|---|
| PIL1/ Line 1 | 108 | 35S::m35S::oEnh:LexA:GAL4_opLexA::GFP | opLexA::G1649 | Increased (17%) | Decreased (2%) | Decreased (3%) |
| PIL1/ Line 2 | 108 | 35S::m35S::oEnh:LexA:GAL4_opLexA::GFP | opLexA::G1649 | Increased (9%) | Decreased (6%) | Decreased (2%) |
| PIL1/ Line 3 | 108 | 35S::m35S::oEnh:LexA:GAL4_opLexA::GFP | opLexA::G1649 | Increased (16%) | Decreased (4%) | Increased (3%) |
| PIL1/ Line 4 | 108 | 35S::m35S::oEnh:LexA:GAL4_opLexA::GFP | opLexA::G1649 | Increased (23%) | — | — |
| PIL1/ Line 5 | 108 | 35S::m35S::oEnh:LexA:GAL4_opLexA::GFP | opLexA::G1649 | Increased (19%) | — | — |
| PIL1/ Line 6 | 108 | 35S::m35S::oEnh:LexA:GAL4_opLexA::GFP | opLexA::G1649 | Increased (18%) | — | — |

The results presented in Table 26 were determined after screening six independent transgenic events. Photosynthetic rate was screened in two independent experiments for lines 1, and 2, and the effect size reported for is the mean of the two screening runs. The direction of the effect was the same in each screening run. Lines 3, 4, 5, and 6 were screened once.

Table 27 details indicators of photosynthetic resource use efficiency observed in *Arabidopsis* plants overexpressing PCL1 in experiments conducted to date.

The biochemical capacity for photosynthesis is a key determinant of the efficiency with which photosynthesis operates relative to resources required for plant growth. The biochemical capacity for photosynthesis is the product of plant resource investment in numerous pigments and proteins required to absorb light and couple it to the enzymatic reduction of carbon in the air, to sugars in the chloroplast. This capacity for photosynthesis sets limits upon the rate of photosynthesis that can be achieved by a leaf, and ultimately the yield potential of crops. Consequently, increasing photosynthesis and photosynthetic capacity is considered a pathway to improving crop yield across broad acres. Table 27 describes increased photosynthesis in four out of five independent lines overexpressing PCL1. When averaged for these five lines photosynthetic rate was increased by 14% in the PCL1 overexpression lines. Table 27 also details how for four of these PCL1 overexpression lines this increase in photosynthetic rate is observed in lines that also displayed an increase in the capacity for photosynthesis. Of the numerous steps that can limit photosynthesis, the activity of Rubisco is a key constraint. FIG. 13 displays evidence of increased in both Rubisco activity in four out of five PCL1 overexpression lines (Long & Bernacchi 2003 already cited above, describe the basis for assaying Rubisco activity and RuBP regeneration capacity).

were screened three times, lines 3, 4 and 5 were screened twice. For all lines the effect size shown is the mean of the individual effects recorded in each independent screening run.

Table 28 details indicators of photosynthetic resource use efficiency observed in *Arabidopsis* plants overexpressing GTL1 in experiments conducted to date.

The ability of a crop canopy to photosynthesize, and the rate at which it can do this relative to the availability of resources, is an important determinant of crop yield. Consequently, increasing the rate of photosynthesis relative to resources that can limit productivity and yield is considered a pathway to improving crop yield across broad acres. Table 28 describes an increase in leaf photosynthetic rate in GTL1 overexpression lines for plants that had decreased leaf chlorophyll content and rosette nitrogen concentration. When averaged for the four lines studied, photosynthetic rate was increased by 12% and leaf chlorophyll content decreased by 20%. Rosette nitrogen content was decreased by 6%, when averaged over the three out of the four lines for which it was measured. Increasing photosynthesis while decreasing both chlorophyll and nitrogen in the rosette provides evidence that GTL1 overexpression improves the efficiency with which photosynthesis operates relative to availability of the key resources of light and nitrogen. This combination of phenotypes would be expected to increase light-limited photosynthesis in the crop canopy while providing protection against photodamage to the photosynthetic apparatus, associated with excess light absorption, in upper canopy leaves.

TABLE 27

Components of increased photosynthetic resource use efficiency in PCL1 overexpression lines. The effects and relative effect size is displayed for leaf photosynthetic rate (photosynthesis) Effects on photosynthetic capacity are also described and where known the biochemical basis for the effect is described as either due to effects on Rubisco activity (Rubisco) or the capacity to regenerate RuBP (RuBP).

| Polypeptide Sequence/Line | SEQ ID NO: | Driver | Target | Photosynthesis | Photosynthetic Capacity |
|---|---|---|---|---|---|
| PCL1/Line 1 | 126 | 35S::m35S::oEnh:LexA:GAL4_opLexA::GFP | opLexA::G2741 | Increased (16%) | Increased Rubisco |
| PCL1/Line 2 | 126 | 35S::m35S::oEnh:LexA:GAL4_opLexA::GFP | opLexA::G2741 | Increased (30%) | Increased Rubisco |
| PCL1/Line 3 | 126 | 35S::m35S::oEnh:LexA:GAL4_opLexA::GFP | opLexA::G2741 | Increased (9%) | Increased Rubisco |
| PCL1/Line 4 | 126 | 35S::m35S::oEnh:LexA:GAL4_opLexA::GFP | opLexA::G2741 | Decreased (3%) | No effect |
| PCL1/Line 5 | 126 | 35S::m35S::oEnh:LexA:GAL4_opLexA::GFP | opLexA::G2741 | Increased (17%) | Increased Rubisco |

The results presented in Table 27 were determined after screening five independent transgenic events. Lines 1 and 2

TABLE 28

Components of increased photosynthetic resource use efficiency in GTL1 overexpression lines. Effects and relative effect size are displayed for leaf chlorophyll content, photosynthetic rate (photosynthesis) and rosette nitrogen concentration (rosette [N]).

| Polypeptide Sequence/Line | SEQ ID NO: | Driver | Target | Leaf Chlorophyll | Photosynthesis | Rosette [N] |
|---|---|---|---|---|---|---|
| GTL1/Line 1 | 156 | prRBCS4::LexA:GAL4_opLexA::GFP, Col_Wt | opLexA::G634 | Decreased (18%) | Increased (10%) | Decreased (7%) |

TABLE 28-continued

Components of increased photosynthetic resource use efficiency in GTL1 overexpression lines. Effects and relative effect size are displayed for leaf chlorophyll content, photosynthetic rate (photosynthesis) and rosette nitrogen concentration (rosette [N]).

| Polypeptide Sequence/ Line | SEQ ID NO: | Driver | Target | Leaf Chlorophyll | Photosynthesis | Rosette [N] |
|---|---|---|---|---|---|---|
| GTL1/ Line 2 | 156 | prRBCS4::LexA:GAL4_opLexA::GFP, Col_Wt | opLexA::G634 | Decreased (12%) | Decreased (3%) | Decreased (6%) |
| GTL1/ Line 3 | 156 | prRBCS4::LexA:GAL4_opLexA::GFP, Col_Wt | opLexA::G634 | Decreased (22%) | Increased (14%) | Decreased (5%) |
| GTL1/ Line 4 | 156 | prRBCS4::LexA:GAL4_opLexA::GFP, Col Wt | opLexA::G634 | Decreased (26%) | Increased (22%) | — |

The results presented in Table 28 were determined after screening four independent transgenic events. Lines 1 and 3 were screened twice, and the effect shown is the mean of the effect observed in both experiments. Lines 2 and 4 were screened once.

Table 29 details indicators of photosynthetic resource use efficiency observed in *Arabidopsis* plants overexpressing DREB2H in experiments conducted to date. Table 29 describes a decrease in leaf chlorophyll in G1755 overexpression lines that has no effect on photosynthetic rate. When averaged for the six lines studied, leaf chlorophyll content was decreased by 19%, while photosynthetic rate was increased by 2%.

Increasing photosynthesis while decreasing chlorophyll provides evidence that DREB2H overexpression improves the efficiency with which photosynthesis operates relative to light availability. This combination of phenotypes would be expected to increase light-limited photosynthesis in the crop canopy while providing protection against photodamage to the photosynthetic apparatus, associated with excess light absorption, in upper canopy leaves.

All experimental observations of greater photosynthetic resource use efficiency were made by comparison to control plants (e.g., plants that did not comprise a recombinant construct encoding a DREB2H-related polypeptide or overexpress a DREB2H clade or phylogenetically-related regulatory protein). Where a numerical value was determined, the percentage increases (+%) or decreases (−%) relative to control plants are shown in parentheses.

FIGS. 20 and 21 detail indicators of photosynthetic resource use efficiency observed in *Arabidopsis* plants overexpressing ERF087 in experiments conducted to date.

The ability of a crop canopy to photosynthesize, and the rate at which it can do this relative to the availability of resources, is an important determinant of crop yield. Consequently, increasing the rate of photosynthesis relative to resources that can limit productivity and yield is considered a pathway to improving crop yield across broad acres. FIGS. 20 and 21 show lower levels of non-photochemical quenching in five out of six ERF087 overexpression lines, as plants acclimated to a sudden increase in light incident on the leaves. The decrease in the ERF087 overexpression lines was most pronounced for plants acclimated to an air temperature of 35° C. (FIG. 21), but was also seen for measurements made at a growth temperature of 22° C. (FIG. 20). Non-photochemical quenching is a term that covers a range of processes that collectively dissipate absorbed light energy as heat from the light harvesting antenna, and thereby regulating the supply of light energy to photosystem two. Decreasing non-photochemical quenching would be expected to increase the efficiency of light energy transfer to the photosynthetic reaction centers and increase the light-use efficiency of photosynthesis.

Table 30 details indicators of photosynthetic resource use efficiency observed in *Arabidopsis* plants overexpressing BBX18 in experiments conducted to date.

The biochemical capacity for photosynthesis is a key determinant of the efficiency with which photosynthesis

TABLE 29

Components of increased photosynthetic resource use efficiency in DREB2H overexpression lines. Effects and relative effect size are displayed for leaf chlorophyll content and photosynthetic rate (photosynthesis).

| Polypeptide Sequence/Line | SEQ ID NO: | Driver | Target | Leaf Chlorophyll | Photo-synthesis |
|---|---|---|---|---|---|
| DREB2H/Line 1 | 192 | 35S:::m35S::oEnh:LexA:GAL4_opLexA::GFP, Col_Wt | opLexA::G1755 | Decreased (18%) | Increased (6%) |
| DREB2H/Line 2 | 192 | 35S:::m35S::oEnh:LexA:GAL4_opLexA::GFP, Col_Wt | opLexA::G1755 | Decreased (19%) | No effect (<1%) |
| DREB2H/Line 3 | 192 | 35S:::m35S::oEnh:LexA:GAL4_opLexA::GFP, Col_Wt | opLexA::G1755 | Decreased (17%) | Decreased (9%) |
| DREB2H/Line 4 | 192 | 35S:::m35S::oEnh:LexA:GAL4_opLexA::GFP, Col_Wt | opLexA::G1755 | Decreased (21%) | Decreased (9%) |
| DREB2H/Line 5 | 192 | 35S:::m35S::oEnh:LexA:GAL4_opLexA::GFP, Col_Wt | opLexA::G1755 | Decreased (14%) | Increased (32%) |
| DREB2H/Line 6 | 192 | 35S:::m35S::oEnh:LexA:GAL4_opLexA::GFP, Col_Wt | opLexA::G1755 | Decreased (24%) | Increased (4%) |

The results presented in Table 29 were determined after screening six independent transgenic events. Lines 2 and 3 were screened twice, and the effect shown is the mean of the effect observed in both experiments. Lines 1, 4, 5 and 6 were screened once.

operates relative to resources required for plant growth. The biochemical capacity for photosynthesis is the product of plant resource investment in numerous pigments and proteins required to absorb light and couple it to the enzymatic reduction of carbon in the air, to sugars in the chloroplast.

This capacity for photosynthesis sets limits upon the rate of photosynthesis that can be achieved by a leaf, and ultimately the yield potential of crops. Consequently, increasing photosynthesis and photosynthetic capacity is considered a pathway to improving crop yield across broad acres. Table 30 describes increased photosynthesis in six out of six independent lines overexpressing BBX18. When averaged for these six lines photosynthetic rate was increased by 28% in the BBX18 overexpression lines. Table 30 also details how for all six of these BBX18 overexpression lines this increase in photosynthetic rate is observed in with an increase in the capacity for photosynthesis. Of the numerous steps that can limit photosynthesis, the activity of Rubisco and the capacity to regenerate RuBP, in the Calvin cycle are key constraints. FIG. 24 displays evidence of an increase in both Rubisco activity and the capacity to regenerate RuBP in the three of the six BBX18 overexpression lines that were assayed for insights into the biochemical basis for increased photosynthetic capacity (Long & Bernacchi 2003 already cited above, describe the basis for assaying Rubisco activity and RuBP regeneration capacity). When averaged over the six lines assayed, the increase in photosynthetic capacity and photosynthetic rate observed in the BBX18 overexpression lines was achieved with no increase in leaf chlorophyll content, providing evidence of optimization of resources within the photosynthetic apparatus.

TABLE 30

Components of increased photosynthetic resource use efficiency in BBX18 overexpression lines. The effects and relative effect size is displayed for leaf photosynthetic rate (photosynthesis) Effects on photosynthetic capacity are also described and, where known the biochemical basis for the effect is described as either due to effects on Rubisco activity (Rubisco) or the capacity to regenerate RuBP (RuBP).

| Polypeptide Sequence/ Line | SEQ ID NO: | Driver | Target | Photosynthesis | Photosynthetic Capacity | Chlorophyll Content Index |
|---|---|---|---|---|---|---|
| BBX18/ Line 1 | 278 | 35S::m35S::oEnh:LexA:GAL4_opLexA::GFP | opLexA::G1881 | Increased (3%) | Increased | Decreased (7%) |
| BBX18/ Line 2 | 278 | 35S::m35S::oEnh:LexA:GAL4_opLexA::GFP | opLexA::G1881 | Increased (16%) | Increased | Decreased (10%) |
| BBX18/ Line 3 | 278 | 35S::m35S::oEnh:LexA:GAL4_opLexA::GFP | opLexA::G1881 | Increased (16%) | Increased | Decreased (6%) |
| BBX18/ Line 4 | 278 | 35S::m35S::oEnh:LexA:GAL4_opLexA::GFP | opLexA::G1881 | Increased (30%) | Increased Rubisco/RuBP | Increased (8%) |
| BBX18/ Line 5 | 278 | 35S::m35S::oEnh:LexA:GAL4_opLexA::GFP | opLexA::G1881 | Increased (72%) | Increased Rubisco/RuBP | Increased (5%) |
| BBX18/ Line 6 | 278 | 35S::m35S::oEnh:LexA:GAL4_opLexA::GFP | opLexA::G1881 | Increased (30%) | Increased Rubisco/RuBP | Increased (10%) |

Table 31 details indicators of photosynthetic resource use efficiency observed in *Arabidopsis* plants overexpressing bHLH60 in experiments conducted to date. Table 31 describes a decrease in leaf chlorophyll in bHLH60 overexpression lines that has no effect on photosynthetic rate. When averaged for the six lines studied, leaf chlorophyll content was decreased by 15%, while photosynthetic rate was decreased by 7%.

Decreasing chlorophyll provides evidence that bHLH60 overexpression improves the efficiency with which photosynthesis operates relative to light availability. This combination of phenotypes would be expected to increase light-limited photosynthesis in the crop canopy while providing protection against photodamage to the photosynthetic apparatus, associated with excess light absorption, in upper canopy leaves.

TABLE 31

Components of increased photosynthetic resource use efficiency in bHLH60 overexpression lines. Effects and relative effect size are displayed for leaf chlorophyll content and photosynthetic rate (photosynthesis).

| Polypeptide Sequence/Line | SEQ ID NO: | Driver | Target | Leaf Chlorophyll | Photo- synthesis |
|---|---|---|---|---|---|
| bHLH60/Line 1 | 318 | 35S::m35S::oEnh:LexA:GAL4_opLexA::GFP, Col_Wt | opLexA::G2144 | Decreased (16%) | Decreased (8%) |
| bHLH60/Line 2 | 318 | 35S::m35S::oEnh:LexA:GAL4_opLexA::GFP, Col_Wt | opLexA::G2144 | Decreased (14%) | Increased (2%) |
| bHLH60/Line 3 | 318 | 35S::m35S::oEnh:LexA:GAL4_opLexA::GFP, Col_Wt | opLexA::G2144 | Decreased (17%) | Decreased (4%) |
| bHLH60/Line 4 | 318 | 35S::m35S::oEnh:LexA:GAL4_opLexA::GFP, Col_Wt | opLexA::G2144 | Decreased (11%) | Decreased (17%) |

The results presented in Table 31 were determined after screening four independent transgenic events. Line 1 and 2 were screened twice and the data presented is the mean of the results of those two experiments. Lines 3 and 4 were screened once.

Table 32 details indicators of photosynthetic resource use efficiency observed in *Arabidopsis* plants overexpressing NF-YC6 in experiments conducted to date. Table 32 describes a decrease in leaf chlorophyll in NF-YC6 overexpression lines that has no effect on photosynthetic rate. When averaged for the five lines studied, leaf chlorophyll content was decreased by 13%, while photosynthetic rate was unaffected (<1% change). Rosette nitrogen content was measured for three of the five lines studied. Averaged for these three lines, rosette nitrogen content was decreased by 7% from 7.3 to 6.7% of rosette dry weight. Increasing photosynthesis while decreasing both chlorophyll and nitrogen in the rosette provides evidence that NF-YC6 overexpression improves the efficiency with which photosynthesis operates relative to the availability of the key resources of light and nitrogen. This combination of phenotypes would be expected to increase light-limited photosynthesis in the crop canopy while providing protection against photodamage to the photosynthetic apparatus, associated with excess light absorption, in upper canopy leaves.

The biochemical capacity for photosynthesis is a key determinant of the efficiency with which photosynthesis operates relative to resources required for plant growth. The biochemical capacity for photosynthesis is the product of plant resource investment in numerous pigments and proteins required to absorb light and couple it to the enzymatic reduction of carbon in the air, to sugars in the chloroplast. This capacity for photosynthesis sets limits upon the rate of photosynthesis that can be achieved by a leaf, and ultimately the yield potential of crops. Consequently, increasing photosynthesis and photosynthetic capacity is considered a pathway to improving crop yield across broad acres. Table 33 describes increased photosynthesis in five out of five independent lines overexpressing bHLH121. When averaged for these five bHLH121 overexpression lines, photosynthetic rate was increased by 11%. Table 33 also details how for four of the five lines, the increase in photosynthetic rate is linked to an increase in capacity for photosynthesis. Of the numerous steps that can limit photosynthesis, the capacity to regenerate RuBP in the Calvin cycle is a key constraint. FIG. 31 displays evidence of an increase in the

TABLE 32

Components of increased photosynthetic resource use efficiency in NF-YC6 overexpression lines. Effects and relative effect size are displayed for leaf chlorophyll content, photosynthetic rate (photosynthesis) and rosette nitrogen concentration (rosette [N]).

| Polypeptide Sequence/ Line | SEQ ID NO: | Driver | Target | Leaf Chlorophyll | Photosynthesis | Rosette [N] |
|---|---|---|---|---|---|---|
| NF-YC6/ Line 1 | 356 | 35S::m35S::oEnh:LexA:GAL4_opLexA:: GFP, Col_Wt | opLexA::G1820 | Decreased (12%) | Decreased (2%) | Decreased (2%) |
| NF-YC6/ Line 2 | 356 | 35S::m35S::oEnh:LexA:GAL4_opLexA:: GFP, Col_Wt | opLexA::G1820 | Decreased (17%) | Increased (8%) | Decreased (9%) |
| NF-YC6/ Line 3 | 356 | 35S::m35S::oEnh:LexA:GAL4_opLexA:: GFP, Col_Wt | opLexA::G1820 | Decreased (11%) | Decreased (3%) | Decreased (11%) |
| NF-YC6/ Line 4 | 356 | 35S::m35S::oEnh:LexA:GAL4_opLexA:: GFP, Col_Wt | opLexA::G1820 | Decreased (20%) | No effect (<1%) | |
| NF-YC6/ Line 5 | 356 | 35S::m35S::oEnh:LexA:GAL4_opLexA:: GFP, Col_Wt | opLexA::G1820 | Decreased (4%) | No effect (<1%) | |

The results presented in Table 32 were determined after screening five independent transgenic events. Lines 1, 2 and 3 were screened twice and the effect size reported for a given parameter is the mean of the two screening runs. Lines 4 and 5 were screened once.

Table 33 details indicators of photosynthetic resource use efficiency observed in *Arabidopsis* plants overexpressing bHLH121 in experiments conducted to date.

capacity to regenerate RuBP in four of the five bHLH121 overexpression lines (Long & Bernacchi 2003 already cited above, describe the basis for RuBP regeneration capacity). All the bHLH121 lines screened were grown in the same environment as the control lines, consequently the increase in photosynthetic capacity and photosynthetic rate observed has been achieved through an increase in photosynthetic resource-use efficiency in these lines.

TABLE 33

Components of increased photosynthetic resource use efficiency in bHLH121 overexpression lines. Effects and relative effect size are displayed for leaf photosynthetic rate (photosynthesis), photosynthetic capacity and leaf chlorophyll content. Where known, the biochemical basis for increase in photosynthetic capacity is described as either due to effects on Rubisco activity (Rubisco) or the capacity to regenerate RuBP (RuBP).

| Polypeptide Sequence/ Line | SEQ ID NO: | Driver | Target | Photosynthesis | Photosynthetic capacity | Leaf Chlorophyll content |
|---|---|---|---|---|---|---|
| bHLH121/ Line 1 | 388 | 35S::m35S::oEnh:LexA:GAL4_opLexA::GFP | opLexA::G782 | Increased (18%) | Increased RuBP | Increased (21%) |
| bHLH121/ Line 2 | 388 | 35S::m35S:oEnh:LexA:GAL4_opLexA:: GFP | opLexA::G782 | Increased (12%) | No effect | Increased (18%) |
| bHLH121/ Line 3 | 388 | 35S::m35S::oEnh:LexA:GAL4_opLexA::GFP | opLexA::G782 | Increased (8%) | Increased RuBP | Increased (8%) |

TABLE 33-continued

Components of increased photosynthetic resource use efficiency in bHLH121 overexpression lines. Effects and relative effect size are displayed for leaf photosynthetic rate (photosynthesis), photosynthetic capacity and leaf chlorophyll content. Where known, the biochemical basis for increase in photosynthetic capacity is described as either due to effects on Rubisco activity (Rubisco) or the capacity to regenerate RuBP (RuBP).

| Polypeptide Sequence/ Line | SEQ ID NO: | Driver | Target | Photosynthesis | Photosynthetic capacity | Leaf Chlorophyll content |
|---|---|---|---|---|---|---|
| bHLH121/ Line 4 | 388 | 35S::m35S::oEnh:LexA:GAL4_opLexA::GFP | opLexA::G782 | Increased (2%) | Increased RuBP | Increased (9%) |
| bHLH121/ Line 5 | 388 | 35S::m35S::oEnh:LexA:GAL4_opLexA::GFP | opLexA::G782 | Increased (14%) | Increased RuBP | Increased (21%) |

The results presented in Table 33 were determined after screening six independent transgenic events. Lines 1 and 2 were screened twice and the effect size reported for a given parameter is the mean of the two screening runs. For both lines the direction of the effect was the same in both runs. Lines 3, 4 and 5 were screened once.

Table 34 details indicators of photosynthetic resource use efficiency observed in Arabidopsis plants overexpressing BBX26 in experiments conducted to date. Table 34 describes increased photosynthesis in five out of five independent lines overexpressing BBX26 When averaged for these five BBX26 overexpression lines, photosynthetic rate was increased by 14%. Table 34 also details how for all five lines, the increase in photosynthetic rate is linked to an increase in capacity for photosynthesis. Of the numerous steps that can limit photosynthesis, the capacity to regenerate RuBP in the Calvin cycle is a key constraint. FIG. 34 displays evidence of an increase in the capacity to regenerate RuBP in four of the five BBX26 overexpression lines (Long & Bernacchi 2003 already cited above, describe the basis for RuBP regeneration capacity). Photosynthetic resource use efficiency was also increased in lines overexpressing BBX26. When averaged for these five lines, the 14% increase in photosynthetic rate was observed in tandem with a 13% increase in leaf chlorophyll content, but also with an 8% decrease in rosette nitrogen content from 7.0% to 6.4%, evidence that leaf nitrogen was being preferentially apportioned to the photosynthetic apparatus.

The results presented in Table 33 were determined after screening six independent transgenic events. Lines 1 and 2 were screened twice and the effect size reported for a given parameter is the mean of the two screening runs. For both lines the direction of the effect was the same in both runs. Lines 3, 4, 5 and 6 were screened once.

Table 35 details indicators of photosynthetic resource use efficiency observed in Arabidopsis plants overexpressing PMT24 in experiments conducted to date.

The biochemical capacity for photosynthesis is a key determinant of the efficiency with which photosynthesis operates relative to resources required for plant growth. The biochemical capacity for photosynthesis is the product of plant resource investment in numerous pigments and proteins required to absorb light and couple it to the enzymatic reduction of carbon in the air, to sugars in the chloroplast. This capacity for photosynthesis sets limits upon the rate of photosynthesis that can be achieved by a leaf, and ultimately the yield potential of crops. Consequently, increasing photosynthesis and photosynthetic capacity is considered a pathway to improving crop yield across broad acres. Table 35 describes increased photosynthesis in five out of seven independent lines overexpressing PMT24. When averaged for these seven PMT24 overexpression lines, photosynthetic rate was increased by 18%. Table 35 also details how for five out of seven lines, the increase in photosynthetic rate is linked to an increase in capacity for photosynthesis. Of the numerous steps that can limit photosynthesis, the capacity to regenerate RuBP in the Calvin cycle is a key constraint. FIG. 34 displays evidence of an increase in the capacity to regenerate RuBP in four of the five PMT24 overexpression lines run through a focused secondary screen (Long &

TABLE 34

Components of increased photosynthetic resource use efficiency in BBX26 overexpression lines. Effects and relative effect size are displayed for leaf photosynthetic rate (photosynthesis), leaf chlorophyll content and rosette nitrogen concentration (rosette [N]). Effects on photosynthetic capacity (P. Cap) are also described and where known, the biochemical basis for the effect is described as either due to effects on Rubisco activity (Rubisco) or the capacity to regenerate RuBP (RuBP).

| Polypeptide Sequence/ Line | SEQ ID NO: | Driver | Target | Photosynthesis | P. Cap | Leaf Chlorophyll content | Rosette [N] |
|---|---|---|---|---|---|---|---|
| BBX26/ Line 1 | 410 | 35S::m35S::oEnh:LexA:GAL4_opLexA::GFP | opLexA::G1486 | Increased (15%) | Increased RuBP | Increased (9%) | Decreased (6%) |
| BBX26/ Line 2 | 410 | 35S::m35S::oEnh:LexA:GAL4_opLexA::GFP | opLexA::G1486 | Increased (13%) | Increased | Increased (24%) | Decreased (5%) |
| BBX26/ Line 3 | 410 | 35S::m35S::oEnh:LexA:GAL4_opLexA::GFP | opLexA::G1486 | Increased (17%) | Increased RuBP | Increased (20%) | Decreased (4%) |
| BBX26/ Line 4 | 410 | 35S::m35S::oEnh:LexA:GAL4_opLexA::GFP | opLexA::G1486 | Increased (15%) | Increased RuBP | Increased (23%) | Decreased (2%) |
| BBX26/ Line 5 | 410 | 35S::m35S::oEnh:LexA:GAL4_opLexA::GFP | opLexA::G1486 | Increased (10%) | Increased RuBP | Decreased (10%) | Decreased (2%) |

Bernacchi 2003 already cited above, describe the basis for RuBP regeneration capacity). This increase in photosynthetic capacity was achieved without any increase in leaf chlorophyll content, which was increased by less than 1% when averaged across all seven lines. These findings suggest that PMT24 overexpression changes resource investment in different components of the photosynthetic apparatus and, because all the PMT24 lines screened were grown in the same environment as the control lines, that the increase in photosynthetic capacity and photosynthetic rate observed has been achieved through an increase in photosynthetic resource-use efficiency in these lines.

in its entirety), and the aldolase and pyruvate orthophosphate dikinase (PPDK) (Taniguchi et al., 2000. *Plant Cell Physiol.* 41:42-48, specifically incorporated herein by reference in its entirety). Other tissue enhanced promoters or inducible promoters are also envisioned that may be used to regulate expression of the disclosed clade member polypeptides and improve photosynthetic resource use efficiency in a variety of plants.

TABLE 35

Components of increased photosynthetic resource use efficiency in PMT24 overexpression lines. Effects and relative effect size are displayed for leaf photosynthetic rate (photosynthesis), photosynthetic capacity and leaf chlorophyll content. Where know the biochemical basis for increase in photosynthetic capacity is described as either due to effects on Rubisco activity (Rubisco) or the capacity to regenerate RuBP (RuBP).

| Polypeptide Sequence/ Line | SEQ ID NO: | Driver | Target | Photosynthesis | Photosynthetic capacity | Leaf chlorophyll content |
|---|---|---|---|---|---|---|
| PMT24/ Line 1 | 444 | 35S::m35S::oEnh:LexA:GAL4_opLexA::GFP | opLexA::G837 | Increased (46%) | Increased | Decreased (3%) |
| PMT24/ Line 2 | 444 | 35S::m35S::oEnh:LexA:GAL4_opLexA::GFP | opLexA::G837 | Increased (26%) | No effect | Increased (2%) |
| PMT24/ Line 3 | 444 | 35S::m35S::oEnh:LexA:GAL4_opLexA::GFP | opLexA::G837 | Increased (34%) | Increased RuBP | Increased (2%) |
| PMT24/ Line 4 | 444 | 35S::m35S::oEnh:LexA:GAL4_opLexA::GFP | opLexA::G837 | No effect (<1%) | Increased RuBP | Increased (4%) |
| PMT24/ Line 5 | 444 | 35S::m35S::oEnh:LexA:GAL4_opLexA::GFP | opLexA::G837 | Decreased (6%) | Increased RuBP | No effect (<1%) |
| PMT24/ Line 6 | 444 | 35S::m35S::oEnh:LexA:GAL4_opLexA::GFP | opLexA::G837 | Increased (14%) | Increased RuBP | Decreased (4%) |
| PMT24/ Line 7 | 444 | 35S::m35S::oEnh:LexA:GAL4_opLexA::GFP | opLexA::G837 | Increased (11%) | No effect | Increased (3%) |

The results presented in Table 35 were determined after screening seven independent transgenic events. Line 3 was screened twice and the effect size reported for a given parameter is the mean of the two screening runs. All other lines were screened once.

The present disclosure thus describes how the transformation of plants, which may include monocots and/or dicots, with an AtMYB27, RBP45A, TCP6, PILL PCL1, GTL1, DREB2H, ERF087, NF-YC6, BBX18, bHLH60, BBX26, bHLH121, or PMT24 clade polypeptide can confer to the transformed plants greater photosynthetic resource use efficiency than the level of photosynthetic resource use efficiency exhibited by control plants. In one embodiment, expression of AtMYB27, RBP45A, TCP6, PILL PCL1, GTL1, DREB2H, ERF087, NF-YC6, BBX18, bHLH60, BBX26, bHLH121, or PMT24 is driven by a constitutive promoter. In another embodiment, expression of AtMYB27, RBP45A, TCP6, PILL PCL1, GTL1, DREB2H, ERF087, NF-YC6, BBX18, bHLH60, BBX26, bHLH121, or PMT24 is driven by a promoter with enhanced activity in a tissue capable of photosynthesis (also referred to herein as a "photosynthetic promoter" or a "photosynthetic tissue-enhanced promoter") such as a leaf tissue or other green tissue. Examples of photosynthetic tissue-enhanced promoters include for example, an RBCS3 promoter (SEQ ID NO: 862), an RBCS4 promoter (SEQ ID NO: 863) or others such as the At4g01060 (also referred to as "G682") promoter (SEQ ID NO: 864), the latter regulating expression in guard cells, or promoters listed in Table 4. Other photosynthetic tissue-enhanced promoters have been taught by Bassett et al., 2007. *BMC Biotechnol.* 7: 47, specifically incorporated herein by reference in its entirety. Other photosynthetic tissue-enhanced promoters of interest include those from the maize aldolase gene FDA (U.S. patent publication no. 20040216189, specifically incorporated herein by reference Example VI. Utilities of AtMYB27, RBP45A, TCP6, PILL PCL1, GTL1, DREB2H, ERF087, NF-YC6, BBX18, bHLH60, BBX26, bHLH121, or PMT24 Clade Sequences for Improving Photosynthetic Resource Use Efficiency, Yield or Biomass By expressing the present polynucleotide sequences in a commercially valuable plant, the plant's phenotype may be altered to one with improved traits related to photosynthetic resource use efficiency or yield. The sequences may be introduced into the commercially valuable plant, by, for example, introducing the polynucleotide in an expression vector or cassette to produce a transgenic plant, or by crossing a target plant with a second plant that comprises said polynucleotide. The transgenic or target plant may be any valuable species of interest, including but not limited to a crop or model plant such as a wheat, *Setaria*, corn (maize), rice, barley, rye, millet, sorghum, turfgrass, sugarcane, miscane, turfgrass, *Miscanthus*, switchgrass, soybean, cotton, rape, oilseed rape including canola, *Eucalyptus*, or poplar plant. The present polynucleotide sequences encode an AtMYB27, RBP45A, TCP6, PILL PCL1, GTL1, DREB2H, ERF087, NF-YC6, BBX18, bHLH60, BBX26, bHLH121, or PMT24 clade polypeptide sequence and the ectopic expression or overexpression in the transgenic or target plant of any of said polypeptides, for example, a polypeptide comprising any of SEQ ID NOs: 2, 42, 86, 108, 126, 156, 192, 246, 278, 318, 356, 388, 410, 444, or SEQ ID NOs: 2n where n=1 to 241, or at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% amino acid identity to any of SEQ ID NOs: 2, 42, 86, 108, 126, 156, 192, 246, 278, 318, 356, 388, 410, or 444, and/or SEQ ID NOs: 2n, where n=1 to 241, and/or at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% amino acid identity to a domain of any of SEQ ID NOs: 483, 490, 510, 538, 566, 588, 599, 608, 623, 629, 659, 686, 702, 721, 741, 760, 769, 786, 813, and/or at least 90%, 91%, 92%, 93%, 94%, 95% m 96% m 97%, 98%, 99%, or about 100% identity to any of consensus sequences SEQ ID NOs: 842-861, can confer improved photosynthetic resource use efficiency or yield in the plant. For plants for which biomass is the product of interest, increasing the expression level of AtMYB27, RBP45A, TCP6, PILL PCL1, GTL1, DREB2H, ERF087, NF-YC6, BBX18, bHLH60, BBX26, bHLH121, or PMT24 clade of polypeptide sequences may increase yield, light use efficiency, photosynthetic capacity, photosynthetic rate, photosynthetic resource use efficiency, vigor, and/or biomass as compared to a control plant of the plants. Thus, it is thus expected that these sequences will improve yield, light use efficiency, photosynthetic capacity, photosynthetic rate, photosynthetic resource use efficiency, vigor, and/or biomass as compared to a control plant in non-*Arabidopsis* plants relative to control plants. This yield improvement may result in yield increases of at least 1%, 2%, 3%, 4%, 5%, 6%, 7%, 8%, 9%, 10%, 11%, 12%, 13%, 14%, 15%, 16%, 17%, 18%, 19%, 20%, 25%, 30% or greater yield relative to the yield that may be obtained with control plants.

It is expected that the same methods may be applied to identify other useful and valuable sequences that are functionally-related and/or closely-related to the listed sequences or domains provided in the instant Tables, and the sequences may be derived from diverse species. Because of morphological, physiological and photosynthetic resource use efficiency similarities that may occur among closely-related sequences, the disclosed clade sequences are expected to increase yield, light use efficiency, photosynthetic capacity, photosynthetic rate, photosynthetic resource use efficiency, vigor, and/or biomass as compared to a control plant to a variety of crop plants, ornamental plants, and woody plants used in the food, ornamental, paper, pulp, lumber or other industries.

Example VII. Expression and Analysis of Increased Yield or Photosynthetic Resource Use Efficiency in Non-*Arabidopsis* or Crop Species Northern blot analysis, RT-PCR or microarray analysis of the regenerated, transformed plants may be used to show expression of a polypeptide or the instant description and related genes that are capable of inducing improved photosynthetic resource use efficiency, and/or larger size.

After a eudicot plant, monocot plant or plant cell has been transformed (and the latter plant host cell regenerated into a plant) and shown to have or produce increased yield, increased light use efficiency, increased photosynthetic capacity, increased photosynthetic rate, photosynthetic resource use efficiency, greater vigor, and/or greater biomass as compared to a control plant relative to a control plant, the transformed monocot plant may be crossed with itself or a plant from the same line, a non-transformed or wild-type monocot plant, or another transformed monocot plant from a different transgenic line of plants.

The function of one or more specific polypeptides of the instant description has been analyzed and may be further characterized and incorporated into crop plants. The ectopic overexpression of one or more of the disclosed clade polypeptide sequences may be regulated using constitutive, inducible, or tissue-enhanced regulatory elements. Genes that have been examined have been shown to modify plant traits including increasing yield and/or photosynthetic resource use efficiency. It is expected that newly discovered polynucleotide and polypeptide sequences closely related, as determined by the disclosed hybridization or identity analyses, to polynucleotide and polypeptide sequences found in the Sequence Listing can also confer alteration of traits in a similar manner to the sequences found in the Sequence Listing, when transformed into any of a considerable variety of plants of different species, and including dicots and monocots. The polynucleotide and polypeptide sequences derived from monocots (e.g., the rice sequences) may be used to transform both monocot and dicot plants, and those derived from dicots (e.g., the *Arabidopsis* and soy genes) may be used to transform either group, although it is expected that some of these sequences will function best if the gene is transformed into a plant from the same group as that from which the sequence is derived.

As an example of a first step to determine photosynthetic resource use efficiency, seeds of these transgenic plants may be grown as described above or methods known in the art.

Closely-related homologs of AtMYB27, RBP45A, TCP6, PILL PCL1, GTL1, DREB2H, ERF087, NF-YC6, BBX18, bHLH60, BBX26, bHLH121, or PMT24 derived from various diverse plant species may be overexpressed in plants and have the same functions of conferring increased photosynthetic resource use efficiency. It is thus expected that structurally similar orthologs of the disclosed polypeptide clades, including SEQ ID NOs: 2n where n=1 to 241, orthologs that comprise any of consensus sequences SEQ ID NOs: 842-861, can confer increased yield, increased light use efficiency, increased photosynthetic capacity, increased photosynthetic rate, increased photosynthetic resource use efficiency, greater vigor, greater biomass, and/or size, relative to control plants. As at least one sequence of the instant description has increased photosynthetic resource use efficiency in *Arabidopsis*, it is expected that the sequences provided in the Sequence Listing, or polypeptide sequences comprising one of or any of the conserved domains provided in the instant Tables, will increase the photosynthetic resource use efficiency and/or yield of transgenic plants including transgenic non-*Arabidopsis* (plant species other than *Arabidopsis* species) crop or other commercially important plant species, including, but not limited to, non-*Arabidopsis* plants and plant species such as monocots and dicots, wheat, *Setaria*, corn (maize), teosinte (*Zea* species which is related to maize), rice, barley, rye, millet, sorghum, turfgrass, sugarcane, miscane, turfgrass, *Miscanthus*, switchgrass, soybean, cotton, rape, oilseed rape including canola, tobacco, tomato, tomatillo, potato, sunflower, alfalfa, clover, banana, blackberry, blueberry, strawberry, raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, watermelon, rosaceous fruits including apple, peach, pear, cherry and plum, and brassicas including broccoli, cabbage, cauliflower, Brussels sprouts, and kohlrabi, currant, avocado, citrus fruits including oranges, lemons, grapefruit and tangerines, artichoke, cherries, endive, leek, roots such as arrowroot, beet, cassava, turnip, radish, yam, and sweet potato, beans, woody species including pine, poplar, *Eucalyptus*, mint or other labiates, nuts such as walnut and peanut. Within each of these species the closely-related homologs of AtMYB27, RBP45A, TCP6, PILL PCL1, GTL1, DREB2H, ERF087, NF-YC6, BBX18, bHLH60, BBX26, bHLH121, or PMT24 may be overexpressed or ectopically expressed in different varieties, cultivars, or germplasm.

The instantly disclosed transgenic plants comprising the disclosed recombinant polynucleotides can be enhanced with other polynucleotides, resulting in a plant or plants with "stacked" or jointly introduced traits, for example, the traits of increased photosynthetic resource use efficiency and improved yield combined with an enhanced trait resulting from expression of a polynucleotide that confers herbicide, insect or and/or pest resistance in a single plant or in two or more parental lines. The disclosed polynucleotides may thus be stacked with a nucleic acid sequence providing other useful or valuable traits such as a nucleic acid sequence from *Bacillus thuringensis* that confers resistance to hemiopteran, homopteran, lepidopteran, coliopteran or other insects or pests.

Thus, the disclosed sequences and closely related, functionally related sequences may be identified that, when ectopically expressed or overexpressed in plants, confer one or more characteristics that lead to greater photosynthetic resource use efficiency. These characteristics include, but are not limited to, the embodiments listed below.

1. A dicot or monocot transgenic plant that has greater or increased photosynthetic resource use efficiency† relative to a control plant;

wherein the transgenic plant comprises an exogenous recombinant polynucleotide comprising a promoter selected from the group consisting of:
   a constitutive promoter, a non-constitutive promoter, an inducible promoter, a tissue-enhanced promoter, and a photosynthetic tissue-enhanced promoter;
   wherein the promoter regulates expression of a polypeptide having a percentage identity to an amino acid sequence comprising an AtMYB27, RBP45A, TCP6, PILL PCL1, GTL1, DREB2H, ERF087, NF-YC6, BBX18, bHLH60, BBX26, bHLH121, or PMT24 clade polypeptide in a photosynthetic or green tissue of the transgenic plant;
   wherein the percentage identity is at least:
   26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to the entire length of any of SEQ ID NOs: 2n, where n=1-241; and/or
   at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to a domain of any of SEQ ID NOs: 483 to 841; and/or
   at least 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical to a consensus sequence of any of SEQ ID NO: 842-861; and/or
   the exogenous recombinant polynucleotide hybridizes with any of SEQ ID NO: 1, 41, 85, 107, 125, 155, 191, 245, 277, 317, 355, 387, 409, or 443 under stringent hybridization conditions followed by one, two, or more wash steps of 6×SSC and 65° C. for ten to thirty minutes per step;
   wherein expression of the polypeptide under the regulatory control of the promoter confers greater or increased photosynthetic resource use efficiency in the transgenic plant relative to the control plant;
   wherein the control plant does not comprise the recombinant polynucleotide; and/or 2. The transgenic plant of embodiment 1, wherein the photosynthetic tissue-enhanced promoter is an RBCS3 promoter, an RBCS4 promoter, an At4g01060 promoter, an Os02g09720 promoter, an Os05g34510 promoter, an Os11g08230 promoter, an Os01g64390 promoter, an Os06g15760 promoter, an Os12g37560 promoter, an Os03g17420 promoter, an Os04g51000 promoter, an Os01g01960 promoter, an Os05g04990 promoter, an Os02g44970 promoter, an Os01g25530 promoter, an Os03g30650 promoter, an Os01g64910 promoter, an Os07g26810 promoter, an Os07g26820 promoter, an Os09g11220 promoter, an Os04g21800 promoter, an Os10g23840 promoter, an Os08g13850 promoter, an Os12g42980 promoter, an Os03g29280 promoter, an Os03g20650 promoter, or an Os06g43920 promoter (SEQ ID NO: 862-888, respectively), or a functional variant thereof, or a functional fragment thereof, or a promoter sequence that is at least 80% identical to SEQ ID NO: 862-888; and/or 3. The transgenic plant of embodiments 1 or 2, wherein:
   the recombinant polynucleotide encodes the polypeptide which comprises any of SEQ ID NOs: 2n, where n=1-241; and/or
   any of SEQ ID NOs: 483, 490, 510, 538, 566, 588, 599, 608, 623, 629, 659, 686, 702, 721, 741, 760, 769, 786, 813; and/or
   any of SEQ ID NO: 842-861; and/or 4. The transgenic plant of any of embodiments 1 to 3, wherein the polypeptide is encoded by
   (a) the exogenous recombinant polynucleotide, or
   (b) a second exogenous recombinant polynucleotide and expression of the polypeptide is regulated by a trans-regulatory element; and/or 5. The transgenic plant of any of embodiments 1 to 4, wherein a plurality of the transgenic plants have greater cumulative canopy photosynthesis than the canopy photosynthesis of the same number of the control plants grown under the same conditions and at the same density; and/or 6. The transgenic plant of any of embodiments 1 to 5, wherein the transgenic plant produces a greater yield than the control plant, including, but not limited to, a greater yield of: vegetative biomass, plant parts, whole plants, shoot vegetative organs/structures (for example, leaves, stems and tubers), roots, flowers and floral organs/structures (for example, bracts, sepals, petals, stamens, carpels, anthers and ovules), seed (including embryo, endosperm, and seed coat) and fruit (the mature ovary), plant tissue (for example, vascular tissue, ground tissue, pulped, pureed, ground-up, macerated or broken-up tissue, and the like) and cells (for example, guard cells, egg cells, and the like); and/or 7. The transgenic plant of any of embodiments 1 to 6, wherein the transgenic plant is selected from the group consisting of a corn, wheat, rice, *Setaria, Miscanthus*, switchgrass, ryegrass, sugarcane, miscane, barley, sorghum, turfgrass, soy, cotton, canola, rapeseed, *Crambe, Camelina*, sugar beet, alfalfa, tomato, *Eucalyptus*, poplar, willow, pine, birch and a woody plant; and/or 8. The transgenic plant of any of embodiments 1 to 7, wherein the transgenic plant is morphologically similar to the control plant at one or more stages of growth, and/or developmentally similar to the control plant.

9. A method for increasing photosynthetic resource use efficiency† in a dicot or monocot plant, the method comprising:

(a) providing one or more dicot or monocot plants that comprise an exogenous recombinant polynucleotide comprising a promoter selected from the group consisting of:

a constitutive promoter, a non-constitutive promoter, an inducible promoter, a tissue-enhanced promoter, and a photosynthetic tissue-enhanced promoter;

wherein the promoter regulates expression of a polypeptide having a percentage identity to an amino acid sequence comprising an AtMYB27, RBP45A, TCP6, PILL PCL1, GTL1, DREB2H, ERF087, NF-YC6, BBX18, bHLH60, BBX26, bHLH121, or PMT24 clade polypeptide in a photosynthetic or green tissue of the dicot or monocot plant;

wherein the percentage identity is at least:
26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to the entire length of any of SEQ ID NOs: 2n, where n=1-241; and/or at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to a domain of any of SEQ ID NOs: 483 to 841; and/or at least 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical to a consensus sequence of any of SEQ ID NO: 842-861; and/or the exogenous recombinant polynucleotide hybridizes with any of SEQ ID NO: 1, 41, 85, 107, 125, 155, 191, 245, 277, 317, 355, 387, 409, or 443 under stringent hybridization conditions followed by one, two, or more wash steps of 6×SSC and 65° C. for ten to thirty minutes per step;

wherein expression of the polypeptide in the one or more dicot or monocot plants confers greater or increased photosynthetic resource use efficiency relative to a control plant that does not comprise the recombinant polynucleotide; and (b) growing the one or more dicot or monocot plants; and/or 10. The method of embodiment 9, wherein the photosynthetic tissue-enhanced promoter is an RBCS3 promoter, an RBCS4 promoter, an At4g01060 promoter, an Os02g09720 promoter, an Os05g34510 promoter, an Os11g08230 promoter, an Os01g64390 promoter, an Os06g15760 promoter, an Os12g37560 promoter, an Os03g17420 promoter, an Os04g51000 promoter, an Os01g01960 promoter, an Os05g04990 promoter, an Os02g44970 promoter, an Os01g25530 promoter, an Os03g30650 promoter, an Os01g64910 promoter, an Os07g26810 promoter, an Os07g26820 promoter, an Os09g11220 promoter, an Os04g21800 promoter, an Os10g23840 promoter, an Os08g13850 promoter, an Os12g42980 promoter, an Os03g29280 promoter, an Os03g20650 promoter, or an Os06g43920 promoter (SEQ ID NO: 862-888, respectively), or a functional variant thereof, or a functional fragment thereof, or a promoter sequence that is at least 80% identical to SEQ ID NO: 862-888; and/or 11. The method of embodiments 9 or 10, wherein an expression cassette comprising the recombinant polynucleotide is introduced into a target plant to produce the dicot or monocot plant comprising the exogenous recombinant polynucleotide; and/or 12. The method of any of embodiments 9 to 11, wherein the polypeptide is encoded by
(a) the exogenous recombinant polynucleotide, or
(b) a second exogenous recombinant polynucleotide and expression of the polypeptide is regulated by a trans-regulatory element; and/or 13. The method of any of embodiments 9 to 12, wherein the dicot or monocot plant is selected for having the increased photosynthetic resource use efficiency relative to the control plant; and/or 14. The method of any of embodiments 9 to 13, wherein the dicot or monocot plant produces a greater yield relative to the control plant; and/or 15. The method of any of embodiments 9 to 14, wherein the dicot or monocot plant is selected for having the greater yield relative to the control plant; and/or 16. The method of any of embodiments 9 to 15, wherein a plurality of the dicot or monocot plants have greater cumulative canopy photosynthesis than the canopy photosynthesis of the same number of the control plants grown under the same conditions and at the same density; and/or 17. The method of any of embodiments 9 to 16, wherein the dicot or monocot plant is selected from the group consisting of a corn, wheat, rice, *Setaria, Miscanthus*, switchgrass, ryegrass, sugarcane, miscane, barley, sorghum, turfgrass, soy, cotton, canola, rapeseed, *Crambe*, Camelina, sugar beet, alfalfa, tomato, *Eucalyptus*, poplar, willow, pine, birch and a woody plant; and/or 18. The method of any of embodiments 9 to 17, the method steps further including:

crossing the dicot or monocot plant with itself, a second plant from the same line as the dicot or monocot plant, a non-transgenic plant, a wild-type plant, or a transgenic plant from a different line of plants, to produce a transgenic seed.

19. A method for producing and selecting a dicot or monocot crop plant with greater yield or greater photosynthetic resource use efficiency† than a control plant, the method comprising:

(a) providing one or more dicot or monocot transgenic plants that comprise an exogenous recombinant polynucleotide comprising a promoter selected from the group consisting of:

a constitutive promoter, a non-constitutive promoter, an inducible promoter, a tissue-enhanced promoter, and a photosynthetic tissue-enhanced promoter;

wherein the promoter regulates expression of a polypeptide having a percentage identity to an amino acid sequence comprising an AtMYB27, RBP45A, TCP6, PIL1 PCL1, GTL1, DREB2H, ERF087, NF-YC6, BBX18, bHLH60, BBX26, bHLH121, or PMT24 clade polypeptide in a photosynthetic or green tissue of the dicot or monocot transgenic plant; wherein the percentage identity is:
  at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to the entire length of any of SEQ ID NOs: 2n, where n=1-241; and/or
  at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to a domain of any of SEQ ID NOs: 483 to 841; and/or
  at least 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical to a consensus sequence of any of SEQ ID NO: 842-861; and/or
  the exogenous recombinant polynucleotide hybridizes with any of SEQ ID NO: 1, 41, 85, 107, 125, 155, 191, 245, 277, 317, 355, 387, 409, or 443 under stringent hybridization conditions followed by one, two, or more wash steps of 6×SSC and 65° C. for ten to thirty minutes per step;
    wherein the photosynthetic tissue-enhanced promoter does not regulate protein expression in a constitutive manner;
  (b) growing a plurality of the dicot or monocot transgenic plants; and
  (c) selecting a dicot or monocot transgenic plant that:
    has greater photosynthetic resource use efficiency than the control plant, wherein the control plant does not comprise the recombinant polynucleotide; and/or
    comprises the recombinant polynucleotide;
  wherein expression of the polypeptide in the selected dicot or monocot transgenic plant confers the greater photosynthetic resource use efficiency or the greater yield relative to the control plant; and/or 20. The method of embodiment 19, the method steps further including:
  (d) crossing the selected dicot or monocot transgenic plant with itself, a second plant from the same line as the selected transgenic plant, a non-transgenic plant, a wild-type plant, or a transgenic plant from a different line of plants, to produce a transgenic seed; and/or 21. The method of embodiment 19 or 20, wherein the dicot or monocot transgenic plant is selected for having the increased photosynthetic resource use efficiency relative to the control plant; and/or 22. The method of any of embodiments 19 to 21, wherein a plurality of the selected dicot or monocot transgenic plants have greater cumulative canopy photosynthesis than the canopy photosynthesis of the same number of the control plants grown under the same conditions and at the same density; and/or 23. The method of any of embodiments 19 to 22, wherein the selected dicot or monocot transgenic plant has an altered trait that confers the greater photosynthetic resource use efficiency.

24. A method for producing a dicot or monocot crop plant with greater photosynthetic resource use efficiency[†] than a control plant, the method comprising:
  (a) providing a dicot or monocot transgenic plant that comprises an exogenous recombinant polynucleotide that comprises a promoter selected from the group consisting of:
    a constitutive promoter, a non-constitutive promoter, an inducible promoter, a tissue-enhanced promoter, or a photosynthetic tissue-enhanced promoter;
    wherein the promoter regulates expression of a polypeptide comprising SEQ ID NO: 2, 42, 86, 108, 126, 156, 192, 246, 278, 318, 356, 388, 410, or 444 in a photosynthetic or green tissue of the transgenic plant to a level that is effective in conferring greater photosynthetic resource use efficiency in the transgenic plant relative to the control plant; and
  (b) measuring an altered trait that confers the greater photosynthetic resource use efficiency,
    wherein expression of the polypeptide in the selected dicot or monocot transgenic plant confers the greater photosynthetic resource use efficiency of the transgenic plant relative to the control plant, thereby producing the crop plant with greater photosynthetic resource use efficiency than the control plant; and/or 25. The method of embodiment 24, wherein the transgenic dicot or monocot plant is selected for having the increased photosynthetic resource use efficiency relative to the control plant.

26. A method for producing a monocot plant with increased grain yield, said method including:
  (a) providing a monocot plant cell or plant tissue with stably integrated, exogenous recombinant polynucleotide comprising a promoter (for example, a constitutive, a non-constitutive, an inducible, a tissue-enhanced, or a photosynthetic tissue-enhanced promoter) that is functional in plant cells and that is operably linked to an exogenous or an endogenous nucleic acid sequence that encodes a polypeptide that has a percentage identity to an amino acid sequence comprising an AtMYB27, RBP45A, TCP6, PIL1, PCL1, GTL1, DREB2H, ERF087, NF-YC6, BBX18, bHLH60, BBX26, bHLH121, or PMT24 clade polypeptide, wherein the percentage identity is:
    at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to the entire length of any of SEQ ID NOs: 2n, where n=1-241; and/or
    at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to a domain of any of SEQ ID NOs: 483 to 841; and/or at least 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical to a consensus sequence of any of SEQ ID NO: 842-861; and/or the exogenous recombinant polynucleotide hybridizes with any of SEQ ID NO: 1, 41, 85, 107, 125, 155, 191, 245, 277, 317, 355, 387, 409, or 443 under stringent hybridization conditions followed by one, two, or more wash steps of 6×SSC and 65° C. for ten to thirty minutes per step;

(b) generating a monocot plant from the plant cell or the plant tissue, wherein the monocot plant comprises the exogenous recombinant polynucleotide, wherein the polypeptide is expressed in a photosynthetic or green tissue of the monocot plant to a level that is effective in conferring greater photosynthetic resource use efficiency† in the monocot plant relative to a control plant that does not contain the recombinant polynucleotide;

(c) growing the monocot plant; and (d) measuring an increase in photosynthetic resource use efficiency of at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 2%, 28%, 29%, or 30% relative to the control plant, or an increase in grain yield of at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 2%, 28%, 29%, or 30% or at least 1, 2, 3, 4, 5, 6, 7, 8, 9, 10, 11, 12, 13, 14, 15, 16, 17, 18, 19, 20 bushels per acre; thereby producing the monocot plant with increased grain yield relative to the control plant; and/or 27. The method of embodiment 26, wherein the AtMYB27, RBP45A, TCP6, PILL PCL1, GTL1, DREB2H, ERF087, NF-YC6, BBX18, bHLH60, BBX26, bHLH121, or PMT24 clade polypeptide comprises a consensus sequence of one or more of any of SEQ ID NOs: 842-861; and/or 28. A transgenic monocot plant produced by the method of embodiment 26; and/or 29. The transgenic monocot plant of embodiment 28, wherein transgenic monocot plant is a corn, wheat, rice, *Miscanthus, Setaria*, switchgrass, ryegrass, sugarcane, miscane, barley, sorghum or turfgrass plant; and/or 30. The method of embodiment 26, wherein the promoter is an RBCS3 promoter, an RBCS4 promoter, an At4g01060 promoter, an Os02g09720 promoter, an Os05g34510 promoter, an Os11g08230 promoter, an Os01g64390 promoter, an Os06g15760 promoter, an Os12g37560 promoter, an Os03g17420 promoter, an Os04g51000 promoter, an Os01g01960 promoter, an Os05g04990 promoter, an Os02g44970 promoter, an Os01g25530 promoter, an Os03g30650 promoter, an Os01g64910 promoter, an Os07g26810 promoter, an Os07g26820 promoter, an Os09g11220 promoter, an Os04g21800 promoter, an Os10g23840 promoter, an Os08g13850 promoter, an Os12g42980 promoter, an Os03g29280 promoter, an Os03g20650 promoter, or an Os06g43920 promoter (SEQ ID NO: 862-888, respectively) or a Cauliflower Mosaic 35S promoter, or a functional variant thereof, or a functional fragment thereof, or a promoter sequence that is at least 80% identical to SEQ ID NO: 862-888; and/or 31. The method of embodiment 28, wherein the clade polypeptide comprises any of SEQ ID NO: 2, 42, 86, 108, 126, 156, 192, 246, 278, 318, 356, 388, 410, or 444.

† In the above embodiments 1, 9, 19, 24, and 26, greater photosynthetic resource use efficiency may be characterized by or measured as, but is not limited to, any one or more of following measurements or characteristics relative to a control plant. The measured or altered trait may be selected from the group consisting of:

(a) increased photosynthetic capacity, measured as an increase in the rate of light-saturated photosynthesis of at least 5%, 10%, 15%, 20%, 25%, 30%, 35%, or 40% when compared to the rate of light-saturated photosynthesis of a control leaf at the same leaf-internal $CO_2$ concentration. Optionally, measurements are made after 40 minutes of acclimation to a light intensity that is saturating for photosynthesis; and/or (b) increased photosynthetic rate, measured as an increase in the rate of light-saturated photosynthesis of at least 5%, 10%, 15%, 19%, 20%, 22%, 23%, 25%, 30%, 32%, 35%, or 40%. Optionally, measurements are made after 40 minutes of acclimation to a light intensity known to be saturating for photosynthesis; and/or (c) a decrease in the chlorophyll content of the leaf of at least 5%, 10%, 15%, 20%, 25%, 30%, 35%, or 40%, observed in the absence of a decrease in photosynthetic capacity; and/or (d) a decrease in the percentage of the leaf dry weight that is nitrogen of at least 0.5%, 1.0%, 1.5%, 2.0%, 2.5%, 3.0%, 3.5%, or 4.0% observed in the absence of a decrease in photosynthetic capacity or increase in dry weight; and/or (e) increased transpiration efficiency, measured as an increase in the rate of light-saturated photosynthesis relative to water loss via transpiration from the leaf, of at least 5%, 10%, 15%, 20%, 25%, 30%, 35%, or 40%; optionally, measurements are made after 40 minutes of acclimation to a light intensity of 700 μmol PAR $m^{-2}$ $s^{-1}$; and/or (f) an increase in the resistance to water vapor diffusion out of the leaf that is exerted by the stomata, measured as a decrease in stomatal conductance to $H_2O$ loss from the leaf of at least 5%, 10%, 15%, 20%, 25%, 30%, 35%, or 40%; optionally, measurements were are after 40 minutes of acclimation to a light intensity of 700 μmol PAR m−2 s−1; and/or (g) a decrease in the resistance to carbon dioxide diffusion into the leaf that is exerted by the stomata, measured as an increase in stomatal conductance of at least 5%, 10%, 13%, 15%, 20%, 25%, 27%, 30%, 35%, 40%, 45%, 50%, 55%, 60%, 65%, or 68%; optionally, measurements were are after 40 minutes of acclimation to a light intensity of 700 μmol PAR m−2 s−1; and/or (h) a decrease in non-photochemical quenching of at least 2%, at least 3%, at least 4%, at least 5%, at least 6%, at least 7%, at least 8%, at least 9%, or at least 10%, for leaf measurements made after 40 minutes of acclimation to a light intensity of 700 μmol PAR $m^{-2}$ $s^{-1}$; and/or (i) a decrease in the ratio of the carbon isotope $^{12}C$ to $^{13}C$ found in either all the dried above-ground biomass, or specific components of the above-ground biomass, e.g., leaves or reproductive structures, of at least 0.5‰(0.5 per mille), or at least 1.0‰, 1.5‰, 2.0‰, 2.5‰, 3.0‰, 3.5‰, or 4.0‰ measured as a decrease in the ratio of $^{12}$C to $^{13}$C relative to the controls with both ratio being expressed relative to the same standard; and/or (j) an increase in the total dry weight of above-ground plant material of at least 5%, 10%, 15%, 20%, 23%, 25%, 30%, 32%, 35%, 40%, 45%, 50%, 55%, 60%, 65%, 70%, or 75%.

All publications and patent applications mentioned in this specification are herein incorporated by reference to the same extent as if each individual publication or patent application was specifically and individually indicated to be incorporated by reference.

The present invention is not limited by the specific embodiments described herein. The invention now being fully described, it will be apparent to one of ordinary skill in the art that many changes and modifications can be made thereto without departing from the spirit or scope of the appended claims. Modifications that become apparent from the foregoing description and accompanying figures fall within the scope of the claims.

SEQUENCE LISTING (888 sequences)

SEQ ID NO: 1 - DNA, 714 bp, Arabidopsis thaliana
  AT3G53200.1
atggattttaagaaggaagaaacacttcgtagagggccatggctcgaagaagaagacgaacggctagtgaaggtcattagtcttttgggagaacgtcgttgggattctttagcaatagtttccggtttgaagaggagtggtaagagttgcaggctaaggtggatgaactatctgaatccgactctgaagcgtggaccgatgagtcaagaagaagagagaatcatctttcagctccatgctctatggggtaacaagtggtcgaagattgcgagaagattacccggtaggactgataacgagataaagaactattggagaactcattatagaaagaaacaggaagctcaaaactatggaaagctctttgagtggagaggaaatacaggagaagaattgttgcacaagtataaggaaacagagatcactaggacaaagacgacgtctcaagaacatggttttgttgaagttgtgagcatggaaagtggtaaagaagccaacggtggtgttggtggaagagaaagcttcggtgttatgaaatcaccgtatgaaaatcggatttcggattggatatcagagatttctactgaccagagtgaagcaaatctttcagaagatcacagcagcaatagctgcagtgagaacaatattaacattggtacttggtggtttcaagagactagggactttgaggagttttcatgttctctatggtca

SEQ ID NO: 2 - protein, 238 aa, Arabidopsis thaliana
  AT3G53200.1 (G1311, Myb1 11-58, Myb2 64-109)
MDFKKEETLRRGPWLEEEDERLVKVISLLGERRWDSLAIVSGLKRSGKSCRLRWMNYLNPTLKRGPMSQEEERIIFQLHALWGNKWSKIARRLPGRTDNEIKNYWRTHYRKKQEAQNYGKLFEWRGNTGEELLHKYKETEITRTKTTSQEHGFVEVVSMESGKEANGGVGGRESFGVMKSPYENRISDWISEISTDQSEANLSEDHSSNSCSENNINIGTWWFQETRDFEEFSCSLWS

SEQ ID NO: 3 - DNA, 696 bp, Glycine max
  Glyma10g06680.1
atgcaaggagaacatttgcgtaaagggacttggctccaagaggaagatgaacaattgactagctttgtgacccgtcttggggagagaaggtgggattcccttgccaaagtagctggcctcaagagaagtggtaaaagctgcaggttaagatggatgaactatcttcgtccaaatctcaagcatggtcattttagtgtcgaagaagagcagcttattgttcagcttcaacaacaattggggaataagtgggcaaagattgctcggaaacttccaggtagaactgacaatgaaatcaagaatttctggagaactcatttaagaaatagagctcaagctcaacaagtcccgggagattttaagtacaaattagaaattgcaacagaagaagtcaaccagaaaagcattgacatggattccaaggattacaaacatggaaacgtttgctgtcaagatagtgagtgggagacaaaggatggtagctccatacacactttacccttatcagattgggaattgggaagctcaccctatgaaactaggatattggattggatagcagaattgcaaaatggatatggtgataaagaactagagcaagattgtaatagcacaggaacgtgcaacaactatagtcctcaagaatttgatgagggatgtgactcatgggattattcaggttccttgtgggatatgaac

SEQ ID NO: 4 - protein, 232 aa, Glycine max
  Glyma10g06680.1 Myb1 8-55, Myb2 61-106
MQGEHLRKGTWLQEEDEQLTSFVTRLGERRWDSLAKVAGLKRSGKSCRLRWMNYLRPNLKHGHFSVEEEQLIVQLQQQLGNKWAKIARKLPGRTDNEIKNFWRTHLRNRAQAQQVPGDFKYKLEIATEEVNQKSIDMDSKDYKHGNVCCQDSEWETKDGSSIHTLPLSDWELGSSPYETRILDWIAELQNGYGDKELEQDCNSTGTCNNYSPQEFDEGCDSWDYSGSLWDMN

SEQ ID NO: 5 - DNA, 531 bp, Glycine max
  Glyma13g20880.1
atgcaaggagaaaatttgcgtaaagggacttggctccaagaggaagatgaacaattgactagctttgtggcccgtcttggggaaagaaggtgggattcccttgccaaagtagctggccttaagagaagtggtaaaagctgtaggttaagatggatgaactatcttcgtccaaatctcaagcatggtcattttagtgttgaagaagagcagcttattgttcagcttcagcaggaattgggtaacaagtgggcaaagattgctcggaaacttccaggaagaactgacaatgaaatcaagaattactggaaaactcatttaagaaaaagagctcaagctcaacaagattgggaattaagaagctcaccctatgaaactaggatattggattggatagcagaattgcaaaatggatatggtgagaacgaactagaacaagattgtaatagcacaggaacgtgcaactattatcctcaagaatttgatgagggatgtgactcatgggattattcaggttccttatgggatatgaac

SEQ ID NO: 6 - protein, 177 aa, Glycine max
  Glyma13g20880.1 Myb1 8-55, Myb2 61-106
MQGENLRKGTWLQEEDEQLTSFVARLGERRWDSLAKVAGLKRSGKSCRLRWMNYLRPNLKHGHFSVEEEQLIVQLQQELGNKWAKIARKLPGRTDNEIKNYWKTHLRKRAQAQQDWELRSSPYETRILDWIAELQNGYGENELEQDCNSTGTCNYYPQEFDEGCDSWDYSGSLWDMN

SEQ ID NO: 7 - DNA, 633 bp, Citrus clementina
  clementine0.9_029544m
atgtcagctaatggtggagctcccacaaaccagtgttctacaactatggatgctgtcattctgcaacaaacaatggtatatcaagcagccatgcaagaagagaaattgcgcaaggggccttggcacgaggaagaagatgagttacttgtaacatttgtaactctttttggggagcgaagatgggattacatagctaaagcatctggtctaaagaggagtggcaagagttgcaggttgcgatggctgaattatcttcgtccaaatattaagcacgggtatataagcactgaagaggaacagatcatcattcaacttcataagaatattaaaatttatttgcacgggtggtcgaggattgcacgaagcttgcctggaagaactgataacgagatcaagaattgttggagaactcgtattagaaagaaaattcaagctcaagagcaagagaactttcaatttggaagaaacaatgccaagcgagattccttattttcgaatcttgattttaatgtgcaaaagcatgagactgatgatgaacacaagcttggggagaatacttttggaactgacaactcattcgatgttcttgggtttccaaactttgcatttgcaagttcaccatacgaaatcgga

SEQ ID NO: 8 - protein, 211 aa, Citrus clementina
  clementine0.9_029544m Myb1 38-85, Myb2 91-139
MSANGGAPTNQCSTTMDAVILQQTMVYQAAMQEEKLRKGPWHEEEDELLVTFVTLFGERRWDYIAKASGLKRSGKSCRLRWLNYLRPNIKHGYISTEEEQIIIQLHKNIKIYLHGWSRIARSLPGRTDNEIKNCWRTRIRKKIQAQEQENFQFGRNNAKRDSLFSNLDFNVQKHETDDEHKLGENTFGTDNSFDVLGFPNFAFASSPYEIG

SEQ ID NO: 9 - DNA, 630 bp, Eucalyptus grandis
  Eucgr.A01648.1
atgatgggtcatcgaggggaagcacgagaagaaaaattgcggaaaggaccttggattgagcaggaggatgagatcttaactgcctttgtcactgttttaggggagaggcggtgggattacattgcaaaaacatcgggtctcaagaggagcggtaagagttgtcgtctacgatggaagaactatctttgccccaatctcaagcacggtcctattagcccggaagaggagaggattattattaaatttcacgagcaatggggcaacaagtggtctaggatagcagaaaagttgccaggaagaaccgacaacgagatcaagaacttctggaaaacccatttgaggaaaaaagtgcagtcttcaaaacaagctttgataggagctgcttgcgacgacccagaatctcaaatgaccacgggtagttccttgaacgttctcagtttctcggacttttcacacttgaattctccatatgagatccgcttgttggattggatgtcggagttcgggaatgatgcaaacgaagtgaattgtgtggactgtaaacactggggcttgtgcttttgttttccaaaatgggattttgaagaagttgataattccatatggaactgcccgggatacctttgggag

SEQ ID NO: 10 - protein, 210 aa, Eucalyptus grandis
  Eucgr.A01648.1 Myb1 15-62, Myb2 68-113
MMGHRGEAREEKLRKGPWIEQEDEILTAFVTVLGERRWDYIAKTSGLKRSGKSCRLRWKNYLCPNLKHGPISPEEERIIIKFHEQWGNKWSRIAEKLPGRTDNEIKNFWKTHLRKKVQSSKQALIGAACDDPESQMTTGSSLNVLSFSDFSHLNSPYEIRLLDWMSEFGNDANEVNCVDCKHWGLCFCFPKWDFEEVDNSIWNCPGYLWE

SEQ ID NO: 11 - DNA, 702 bp, Populus trichocarpa
  POPTR_0006s12400.1
atggcttgtcaaggagacaaattgcgtaaagggtcttggcaggaggaggaagatgagcgattaacagcttctgcaactcttttaggggaacgaaagtgggactccatagcaagattatctggtctgatgaggagcggtaagagttgcagaatgaggtggctgaactaccttcaacccaatcttaagcgcggtcatataagtgctgaagaagagcagattattattcaatttcatgggcaatggggtaacaaatgggcaaggattgctcgaaggttgcccggtagaactgacaatgagatcaagaactactggagaactcatatgagaaaggaaatacaaaccgaagaagaaggaaattttcagcccaaagtttacagtgccaaaccagagttgctgtatcaaaatggcgacagtactagtgcctggaaatatagcatcagagactacaactctgttgatgataatatcggacccgcaggctcttccttggaacattatgagttaccaagcctgacacacatgaactcaccatatgagaccaggcaatatgattggattccaaagttgtccaatgatcagagtcaaacagaagttcatggggagggtaatggtttagactggtgtttctgtgatccagcttggaactctgaagatagtgacattagcacattggtctctttgggttctctctgggatatgaat

SEQ ID NO: 12 - protein, 234 aa, Populus trichocarpa
  POPTR_0006s12400.1 Myb1 10-57, Myb2 63-108
MACQGDKLRKGSWQEEEDERLTASATLLGERKWDSIARLSGLMRSGKSCRMRWLNYLQPNLKRGHISAEEEQIIIQFHGQWGNKWARIARRLPGRTDNEIKNYWRTHMRKEIQTEEEGNFQPKVYSAKPELLYQNGDSTSAWKYSIRDYNSVDDNIGPAGSSLEHYELPSLTHMNSPYETRQYDWIPKLSNDQSQTEVHGEGNGLDWCFCDPAWNSEDSDISTLVSLGSLWDMN

SEQ ID NO: 13 - DNA, 369 bp, Vitis vinifera
  GSVIVT01033670001
atgcaaggggaaaatttgcgtaaagggtcttggcttgaagaggaagatgagcgactgactgcctttgttggactgttgggggaacggcgctgggactctattgcaagagcatcaggtctaaaaaggagcggtaagagttgcaggttgcggtggttgaactatcttcgccctgaccttaaacgttgtcagataagcgctgaagaagagcaaatcatccttcaacttcacaaacgatggggtaacaagtggtcgtggattgcaagaagcttgccaggaagaaccgataatgagataaagaattactggagaactcatttgaggaagaggacagaaattgaagaacaaggtatactgcaattttctgcttct

SEQ ID NO: 14 - protein, 123 aa, Vitis vinifera
  GSVIVT01033670001 Myb1 8-55, Myb2 61-106
MQGENLRKGSWLEEEDERLTAFVGLLGERRWDSIARASGLKRSGKSCRLRWLNYLRPDLKRCQISAEEEQIILQLHKRWGNKWSWIARSLPGRTDNEIKNYWRTHLRKRTEIEEQGILQFSAS

SEQ ID NO: 15 - DNA, 1425 bp, Brachypodium distachyon
  Bradi5g22410.1
atgatgcagcagcctccgccgtcgcagccacagcccggcatgggggcgcccatgcctccgcaaggcgcggccgggcagcctcctcagtggggcacgatcccgccgccgatgccgcatcagtacgcgcaaccgccgccgcagcagccgcaggcgatgtggggccagccgccgccacaggcggcctatgggcaaccgcctgctccgcagcagtactacgctgctcctcaggcgccgtccgctcccgcggcggcggacgaggtgaggacgctctggatcggagatctccagtactggatggacgagacttacatccacggctgcttcgcgtccaccggggagcttcaatccgtgaagcttatccgtgacaagcaaactggacaacttcagggttatggctttgttgagtttacgagccatgcagccgctgagcgagttcttcaagggtacaatggacatgcaatgccaaatgttgacctagcatacagactgaattgggccagtgctggtgaaaagcgtgatgataccccagattatacaatttttgttggggatttggcagcagatgttacagattacatattacaagagacattcagggtccattacccttcagtgaagggcgcaaaagttgtcactgataagatgacaatgcgttcaaagggttatggatttgtaaaattcggtgatcctacagagcaagctcgtgccatgacagaaatgaatgggatgccttgttcttccagacctatgcgcattggtccagcagcaaatagaaaaacaacaggggttcaggagagagtaccaaatacaaatactcaaggagctcagtctgacaatgatcctaacaataccaccatatttgttggtggccttgaccccaatgtcactgaagacgccttgaaacaagtgtttgctccttatggagaagttatccatgttaagatccctgttgggaaaagatgtggttttgttcagtttgtaaacaggccttctgctgagcaagctctgcaaatgctgcaagggaccccaattggtgggcagaatgttaggctttcatggggacgtagcccttcgaacaagcaggctcagcctcagcaggaatccagccagtggggtgctaatgctggtgctggttactatggtggctatggacaaggttatgatgcttatggcgggtatgcacaacctcaagatcctaacatgtatggttatggagcttatgctggttatcccaattaccaacaacaagcagtagcacagcagccgccacaacaacaggtgaatgagtcgaggcacgtcagaacccatttgaaggaactgtcaagccatgttcgagtacttgtcaatagagagagagagagagggacggtttatagactccagattttgattgcctctggcaaggtctatttatgcactgtatta

SEQ ID NO: 16 - protein, 475 aa, Brachypodium distachyon
  Bradi5g22410.1 (RRM1 89-167, RRM2 177-256, RRM3 284-356)
MMQQPPPSQPQPGMGAPMPPQGAAGQPPQWGTIPPPMPHQYAQPPPQQPQAMWGQPPPQAAYGQPPAPQQYYAAPQAPSAPAAADEVRTLWIGDLQYWMDETYIHGCFASTGELQSVKLIRDKQTGQLQGYGFVEFTSHAAAERVLQGYNGHAMPNVDLAYRLNWASAGEKRDDTPDYTIFVGDLAADVTDYILQETFRVHYPSVKGAKVVTDKMTMRSKGYGFVKFGDPTEQARAMTEMNGMPCSSRPMRIGPAANRKTTGVQERVPNTNTQGAQSDNDPNNTTIFVGGLDPNVTEDALKQVFAPYGEVIHVKIPVGKRCGFVQFVNRPSAEQALQMLQGTPIGGQNVRLSWGRSPSNKQAQPQQESSQWGANAGAGYYGGYGQGYDAYGGYAQPQDPNMYGYGAYAGYPNYQQQAVAQQPPQQQVNESRHVRTHLKELSSHVRVLVNRERERGTVYRLQILIASGKVYLCTVL

SEQ ID NO: 17 - DNA, 1296 bp, Zea mays
  GRMZM2G012628_T01
atgatgcagcagcccccgccgcagcagccgcagccgggcatggcgccgcctccgcctccgcaggctgctggcgggcagccaccgcagtggggtgggatcccgccgccgatggcgcagcagtacggcgcaccgcctccgcagcagcctccggcgatgtggggccagcctccgccgcaggcgcactacgggcaggcaccaacccctcagcagtactacgccgcgccgccggtgccggtgcaggcgccagccgcccccgctgcggcggacgaggtcaggacgctctggatcggggacctgcaatactggatggacgagaactacgtcttcgggtgcttttcgaacactggggaggttcaaaatgtgaagctcatccgtgacaagaattcagggcagcttcagggttatggttttgttgagtttacaagccgtgcagctgcagaacgagttcttcagacatacaatggacaaatgatgccaaatgttgacttgacatttcggctgaattgggccagtgctggtgaaaagcgcgatgatactcctgaatatactatttttgttggggatttggctgcagatgttacagattacttgttacaagagacattcagggttcattatccctctgtcaagggtgcaaaagttgtgactgataaattgacaatgcgcacaaagggttatggatttgtgaaatttggtgatcctacagagcaagctcgtgcaatgactgaaatgaatggaatgccttgttcttccaggcctatgcgtattggtcctgcagcaagtaggaaaaatacaggaggtgttgttcaagagagagtaccaaattctcaaggagctcagtctgagaatgatcctaacaataccactatatttgttggtgggcttgaccccaatgtcactgaagataccctaaaacaagttttttctccttacggtgaagtcgtccatgttaagatccctgttgggaagagatgtggttttgttcagttcgttaccagaccttctgctgaacaagcgctgctaatgctgcaaggggccttgattggtgcacagaatgttcgactttcatggggtagaagcctgtcgaacaagcaggctcagcctcagcaggaatccaatcaatggggtgcggctgctggtgctggtggctactatgggggctatggacaaggttatgaggcttatggcagtgggtatgcacaaccccaggatcctaacatgtatggttatggcgcttatggcggttatcccaattaccaacagcaaccagctgcacagcagcaacagcaacaacag

SEQ ID NO: 18 - protein, 432 aa, Zea mays
  GRMZM2G012628_T01 (RRM1 93-171, RRM2 181-260, RRM3 288-360)
MMQQPPPQQPQPGMAPPPPPQAAGGQPPQWGGIPPPMAQQYGAPPPQQPPAMWGQPPPQAHYGQAPTPQQYYAAPPVPVQAPAAPAAADEVRTLWIGDLQYWMDENYVFGCFSNTGEVQNVKLIRDKNSGQLQGYGFVEFTSRAAAERVLQTYNGQMMPNVDLTFRLNWASAGEKRDDTPEYTIFVGDLAADVTDYLLQETFRVHYPSVKGAKVVTDKLTMRTKGYGFVKFGDPTEQARAMTEMNGMPCSSRPMRIGPAASRKNTGGVVQERVPNSQGAQSENDPNNTTIFVGGLDPNVTEDTLKQVFSPYGEVVHVKIPVGKRCGFVQFVTRPSAEQALLMLQGALIGAQNVRLSWGRSLSNKQAQPQQESNQWGAAAGAGGYYGGYGQGYEAYGSGYAQPQDPNMYGYGAYGGYPNYQQQPAAQQQQQQQ

SEQ ID NO: 19 - DNA, 1281 bp, Zea mays
  GRMZM2G058098_T02
atgatgcagcagcccccgcagccgcagccgggtatggcgctacctcctccccctcagaccggtggcgggcagccaccgcagtggggcgcgatcccgccgccgatgacgcagcagtacggcgcaccacctccgcagcagcctccagcgatgtggggccagcctccgtcgcaggcgcactacgggcaggcgccgccccctcagccgtattatgccgcgccgccggtgccggccgcccccgctgcggcggacgaggtcaggacgctctggatcggggacctgcagtactggatggacgataactatgtcttcgggtgcttttcgaacaccggcgaggttcaaaatgtgaagctcatccgcgacaagaattcaggacagcttcagggctatggttttgttgaatttacaagccgtgcagctgcagagcgagttcttcagacatataatggacaaatgatgccaaatgttgacttgacatttcggctgaactgggccagtgctggtgaaaagcgtgatgatactcctgactatactattttcgttggtgatttggctgcagatgttacagattacttgttacaagagacattcagggttcattatccctcggtgaagggtgcaaaagttgtgactgataaattgacaatgcgtaccaagggttatggatttgtgaaatttggcgatcctacagagcaagctcgtgcaatgactgaaatgaatggaatgccttgttcttccaggcctatgcgtattggtcctgcagcaagtagaaaaaatgcaggtggtgttgttcaagagagagtaccaaattctcaaggagctcagtctgagaatgatcctaacaataccactatatttgttggtgggcttgaccccaatgtcactgaagatgtcctaaaacaagcattttctccttatggcgaagtcatccatgttaagatccctgttgggaagagatgtggttttgttcagtttgttaccagaccttctgctgagcaggcgctgctaatgttgcaaggggccttgattggtgcacagaatgttcggctttcgtggggtagaagcctgtcgaacaagcagactcagcctcagcaggaatccatgcaatggggtgcgggtgcgcctgctggtgttggtgattactatggtggctatggacaaggttatgaggcttatggcagtgggtatgcacaaccccaggaccctaacatgtatggttatggcgcttatgttggttatcccaattaccaacagcaaccagctgcacagcagccacagcaacaa

SEQ ID NO: 20 - protein, 428 aa, Zea mays
  GRMZM2G058098_T02 (RRM1 175-254, RRM2 282-354, RRM3 260-332)
MMQQPPQPQPGMALPPPPQTGGGQPPQWGAIPPPMTQQYGAPPPQQPPAMWGQPPSQAHYGQAPPPQPYYAAPPVPAAPAAADEVRTLWIGDLQYWMDDNYVFGCFSNTGEVQNVKLIRDKNSGQLQGYGFVEFTSRAAAERVLQTYNGQMMPNVDLTFRLNWASAGEKRDDTPDYTIFVGDLAADVTDYLLQETFRVHYPSVKGAKVVTDKLTMRTKGYGFVKFGDPTEQARAMTEMNGMPCSSRPMRIGPAASRKNAGGVVQERVPNSQGAQSENDPNNTTIFVGGLDPNVTEDVLKQAFSPYGEVIHVKIPVGKRCGFVQFVTRPSAEQALLMLQGALIGAQNVRLSWGRSLSNKQTQPQQESMQWGAGAPAGVGDYYGGYGQGYEAYGSGYAQPQDPNMYGYGAYVGYPNYQQQPAAQQPQQQQ

SEQ ID NO: 21 - DNA, 1305 bp, Brachypodium distachyon
  Bradi3g15180.1
atgatgccgcagccgcagcccggggtcgccccgctgccgcacccgcagcaggcgccgaccggcgcgccgccgcagtggggcaccatcccgccgcccatgccgccgcagcagcactacgcgccgccgcccccacagcagcaccacgcgcctcccccgccgcagatgtggggccaggtgcccccgccccagcaggccgccccgtacggccaggccccgccgccgccccagcatgccgcctactacggcgcgccggcggcacccgcgcaggcccctgcgggccccaacgaggtcaggacgctctggatcggggacctacagtactggatggacgagaactacgtctacgggtgcttcgcgcacaccggcgaggtacaatctgtgaagttgattcgtgacaagcaaactggacaacttcagggttacggttttgttgaattcacaacccgtgctggtgctgaaagagttcttcaaacatacaatggggcaacaatgccaaatgttgagatgccatacagattgaattgggcctctgctggtgaaaaacgtgatgatggccctgattacacaatatttgttggtgatttggctgctgatgttacagactacatattacaagagacatttagggtacattacccgtctgtgaagggtgcaaaggttgtcacagataaactgactatgcgctcgaagggctatggctttgtgaaattcagtgatcctaccgagcaaactcgtgcgatgactgaaatgaacgggatggtatgttcctcaaggcccatgcgtattggtccagctgcaaataagcagaaagtatctggagctcaagagaaagtaccaagtgctcaaggagttcagtctgacagtgatcctagcaataccactatatttgtcggtggacttgacccaaatgtcactgaagatatgttaaaacaagttttcgctccttatggtgaagtggtccatgttaagatccctgttggcaaaagatgtggttttgttcaatatgctagcaggtcctcttctgaggaggcattgctgatgctgcaaggtactgtgattggagggcagaatgtgaggctttcatggggtcggagcccttcaaacaaacaagttcagactcctcaagactcgaatcagtggggtggtgctactgctaatgctggctactatggctatggacaaggttatgaggcgtatggatatgctgctcaacctcaggacccaaatatgtatgggtatggagcatatgctgggtatccaaattatccacagcaacaagcagcacagcagccacagcagcaacag

SEQ ID NO: 22 - protein, 435 aa, Brachypodium distachyon
  Bradi3g15180.1 (RRM1 99-177, RRM2 187-266, RRM3 293-365)
MMPQPQPGVAPLPHPQQAPTGAPPQWGTIPPPMPPQQHYAPPPPQQHHAPPPPQMWGQVPPPQQAAPYGQAPPPPQHAAYYGAPAAPAQAPAGPNEVRTLWIGDLQYWMDENYVYGCFAHTGEVQSVKLIRDKQTGQLQGYGFVEFTTRAGAERVLQTYNGATMPNVEMPYRLNWASAGEKRDDGPDYTIFVGDLAADVTDYILQETFRVHYPSVKGAKVVTDKLTMRSKGYGFVKFSDPTEQTRAMTEMNGMVCSSRPMRIGPAANKQKVSGAQEKVPSAQGVQSDSDPSNTTIFVGGLDPNVTEDMLKQVFAPYGEVVHVKIPVGKRCGFVQYASRSSSEEALLMLQGTVIGGQNVRLSWGRSPSNKQVQTPQDSNQWGGATANAGYYGYGQGYEAYGYAAQPQDPNMYGYGAYAGYPNYPQQQAAQQPQQQQ

SEQ ID NO: 23 - DNA, 1302 bp, Oryza sativa
  LOC_Os08g09100.1
atggccccgccgccgccgcccccgcaggcgggggtcgccgggggcggcggcgcgccgccgcagtggggcgccatccctcccccggtgccgcaccaacagcagcagtacgcgccgccgccgccgcagatgtggggccaggctcccccgccgccgccgcagatgtggggccaggctcccccgccgccgcagcccgcgtacggccagccgccgccggcccaggcggggtactacggggcgccgccgcaggcggccccggccgtccccgcggggcccaacgaggtcaggacgctctggatcggggatctccagtactggatggatgagaactacatctccgcctgctttgcgcccaccggcgagctacaatctgtgaagctaattcgtgacaagcagactggacaacttcagggttatggctttattgaattcacatcccatgctggtgctgaaagagttcttcaaacatacaatggggcaatgatgccaaatgttgagcagacataccggttgaattgggcctctgctggtgaaaaacgtgatgatacccctgattacacaatttttgttggtgatttggctgctgatgttacagactacatattgcaagagacgttcagggtacattacccatctgtgaagggtgcaaaggttgtgacagataaaatgacaatgcgttcaaagggctatggcttcgtcaaatttggtgatccttccgagcaagcccgtgcaatgacagaaatgaatgggatggtttgttcttcaagacctatgcgtatcggcccagctgcaaataagaaagcaactggagttcaagagaaagtaccgagtgctcaaggagttcagtctgacagtgatcctagcaataccactatatttgttggtggccttgatcccagtgtcactgacgatatgttgaaacaagttttcactccctatggagatgtggtccatgttaagatcccagttggaaaaagatgtggttttgttcaatttgctaacagagcttctgcagatgaagctttggtacttctacaaggtaccttgattggaggacagaatgtgaggctttcatggggccgcagcccttcaaatagacaagctcagcctcaacaggattccaaccagtggggtggtgctaatgctggatactacggttatgggcaaggatatgagggttatgggtatgctcaacctcaggaccctaatatgtacgggtatggagcttatgctggttatcccaactaccaacaacccctagctcagcagccgcagcagcaacaggtgagagctgtgctttttaac

SEQ ID NO: 24 - protein, 434 aa, Oryza sativa
  LOC_Os08g09100.1 (RRM1 96-174, RRM2 184-263, RRM3 289-361)
MAPPPPPPQAGVAGGGGAPPQWGAIPPPVPHQQQQYAPPPPQMWGQAPPPPPQMWGQAPPPPQPAYGQPPPAQAGYYGAPPQAAPAVPAGPNEVRTLWIGDLQYWMDENYISACFAPTGELQSVKLIRDKQTGQLQGYGFIEFTSHAGAERVLQTYNGAMMPNVEQTYRLNWASAGEKRDDTPDYTIFVGDLAADVTDYILQETFRVHYPSVKGAKVVTDKMTMRSKGYGFVKFGDPSEQARAMTEMNGMVCSSRPMRIGPAANKKATGVQEKVPSAQGVQSDSDPSNTTIFVGGLDPSVTDDMLKQVFTPYGDVVHVKIPVGKRCGFVQFANRASADEALVLLQGTLIGGQNVRLSWGRSPSNRQAQPQQDSNQWGGANAGYYGYGQGYEGYGYAQPQDPNMYGYGAYAGYPNYQQPLAQQPQQQQVRAVLFN

SEQ ID NO: 25 - DNA, 1359 bp, Zea mays
  GRMZM2G426591_T01
atgatgccgcagcagcagcagcccggcatggcccctcctcctccacaggccgcccccggagcgccgccacactggggcggcatcccgccgcctatggcccctcagcatcagtacgcgccaccaccgacccatcaggccccgcccccgccgcagatgtggggccaggcgcccccgcccccgcccccgcctcaggccgcgtacggtcaggcgcccccgccgccccaggccgcgtatggccaggcgctcccaccaccccaggccgcgtacggccaggcgcctcccccgccacaggccgcctactacggggcggtacccgcgcccgcggcggtggccgcggcacctgtcgggcccagcgaggtcaggacgctctggatcggggatctgcagtactggatggacgataactacatctacgggtgcttcgcatccacgggggaggtgcaaaatgtgaagctaattcgtgacaagcatactggacaacttcagggctatggttttattgaattcataagccgcgctgctgctgaaagagttcttcagacttacaacgggacaatgatgccaaatgttgagttgccattccggttgaattgggctagtgctggtgaaaaacgtgatgacacccccgactatacaatatttgttggtgatttggctgctgatgttacagactatgtattacaagagacatttagggcacattacccttctgtgaagggtgcaaaagttgtaacagacaagctgacaatgcgcacaaagggttatggttttgtgaagtttggtgatcctaatgagcaagctcgtgcaatgactgagatgaatggcatgctatgttcttctaggcctatgcgtattgggcctgctgcaaacaagaaagctactgttgttcaggagaaagtaccaagtgctcagggagttcagtctgacaatgatcctaacaatacaaccatttttgttggtggtcttgaccccaatgtcactgaagatatgttgaaacaagttttcaccccttatggggacgtagtccatgttaagattcctgttggcaaaagatgtggttttgttcaatatgctaacagatcttcggcagaggaggcattggtaattctgcaaggcaccttggttggagggcagaatgtgaggctttcatggggtcgcagcccttcaaacaaacaagttcaggactccaaccagtgggccggggctaatgctggatattatggctacggtcaaggctatgaggcctatgggtacccccagtctcaggaccctaatatgtataattatggagctggagcttatgctggctatccaaattaccaacaacaaccagtagcacagcaaccgccgcagcaacag

SEQ ID NO: 26 - protein, 453 aa, Zea mays
  GRMZM2G426591_T01 (RRM1 122-200, RRM2 210-289, RRM3 315-387)
MMPQQQQPGMAPPPPQAAPGAPPHWGGIPPPMAPQHQYAPPPTHQAPPPPQMWGQAPPPPPPPQAAYGQAPPPPQAAYGQALPPPQAAYGQAPPPPQAAYYGAVPAPAAVAAAPVGPSEVRTLWIGDLQYWMDDNYIYGCFASTGEVQNVKLIRDKHTGQLQGYGFIEFISRAAAERVLQTYNGTMMPNVELPFRLNWASAGEKRDDTPDYTIFVGDLAADVTDYVLQETFRAHYPSVKGAKVVTDKLTMRTKGYGFVKFGDPNEQARAMTEMNGMLCSSRPMRIGPAANKKATVVQEKVPSAQGVQSDNDPNNTTIFVGGLDPNVTEDMLKQVFTPYGDVVHVKIPVGKRCGFVQYANRSSAEEALVILQGTLVGGQNVRLSWGRSPSNKQVQDSNQWAGANAGYYGYGQGYEAYGYPQSQDPNMYNYGAGAYAGYPNYQQQPVAQQPPQQQ

SEQ ID NO: 27 - DNA, 1401 bp, Brachypodium distachyon
  Bradi1g26210.1
atgcagccgccgtaccagccgccgatgaacgggcagcacgcgcccccgcaggctccgccgcagtcctctggtcctccgcctccgcctccgcagcagcaggtccccccgccgcagcagtactaccaggcgccaccgcagtactaccagccgggacctccgccgccgatgtggggccatccgcagcagcatatgcctccgcagtacgcccccccaccgcagcagtacgcgcctccgccccctcaccagtacgggccaccaccgcagcagtacgcgcagccgccgccgcagcagtacggagcgcagatggcgggcgggcccgcgcccggaggcgaggatatcaggtccctgtggattggagatctccagtactggatggatgaggcctacctccataacgcttttgcgcccatggggccgcagcaggttgcctcagtgaaaattatccgcaacaagcaaactggacagccagagggttatggttttattgaatttcactctcgagctgctgcagaatatgccctggcgtcctttaatgggcatgcgatgcctaatgttgatctgccttttaaactaaactgggcttctgctagcgctggtgataggcgtggggatgatggttctgatcacacaatatttgttggtgatttggcttctgatgttactgactccatgctgcaagaaatattcaaagccagctacccttcagttagaggagctaacgttgttaccgacagggcaacaggacgctccaaaggatacggttttgtacgttttggggatgtaaatgagcagacacgtgctatgactgagatgaatggtgtgacattgtcttcaaggcaattgaggattgggcctgcggccaacaagaagaatatgggtactcagcagacatattcgactaatgggtaccagtcccagagctctcaaggaaatgatgttcagaatgatcccaataatactacaatctttgtgggcgggttagattccaatatagatgagaactatctaaggcaagtttttactccatatggcgaagttggttatgtgaagattcctgtaggcaagcgttgtggatttgtccaatttaccagcaggtcatgcgctgaggaagccatcaatgcgctgaacgggaccccgattggcgggaataatgttcgtctttcatggggccgtagtacccaaaacaaacaggctccccagcaggatgcaaaccagggtaatggcagcaattactatggataccaacagggtaatgatgcttactatggtgcacccaatgcgcaagatcctagcatgcaaaactatggatattctggttatggcaattacgagcagcagcagccagcacagcagcagcaaccaccgccttctcagcagcagcagcagcagcccccacagcag

SEQ ID NO: 28 - protein, 467 aa, Brachypodium distachyon
  Bradi1g26210.1 (RRM1 115-197, RRM2 208-287, RRM3 320-392)
MQPPYQPPMNGQHAPPQAPPQSSGPPPPPPQQQVPPPQQYYQAPPQYYQPGPPPPMWGHPQQHMPPQYAPPPQQYAPPPPHQYGPPPQQYAQPPPQQYGAQMAGGPAPGGEDIRSLWIGDLQYWMDEAYLHNAFAPMGPQQVASVKIIRNKQTGQPEGYGFIEFHSRAAAEYALASFNGHAMPNVDLPFKLNWASASAGDRRGDDGSDHTIFVGDLASDVTDSMLQEIFKASYPSVRGANVVTDRATGRSKGYGFVRFGDVNEQTRAMTEMNGVTLSSRQLRIGPAANKKNMGTQQTYSTNGYQSQSSQGNDVQNDPNNTTIFVGGLDSNIDENYLRQVFTPYGEVGYVKIPVGKRCGFVQFTSRSCAEEAINALNGTPIGGNNVRLSWGRSTQNKQAPQQDANQGNGSNYYGYQQGNDAYYGAPNAQDPSMQNYGYSGYGNYEQQQPAQQQQPPPSQQQQQQPPQQ

SEQ ID NO: 29 - DNA, 1467 bp, Oryza sativa
  LOC_Os07g33330.1
atgcagcagcctcccccgccgacgatgaacggcggccaccacgcggcccctcctccgccgcaggtctccggggcgcccccgccgccgcatggccactaccagcagcagccgccgcctcagccgtactgccagcagcagcagccgctgccgccgcactactaccaggcggggcccccgcacgcgcctccgccgcagcagccgccggcgatgtggggccagccgccgccgccgccgccgcagtacgcgccacctccgccccagcagttccagctcccgcaccagcagtacgcacctccccctcagcattacgcgccgccgccgccgcagcagcagtacggggcgcagatggctggcgggcccgctccgggaggcgacgagatcaggtcgctgtggatcggggatctccagtactggatggatgagagctacctctccaacgcttttgcccccatgggacagcaggttacctctgtgaaagtcatccgcaacaagcagagtgggcactctgagggttatggttttattgaatttcagtctcacgctgctgcagaatatgctctggctaactttaatgggaggatgatgcttaatgttgaccaacttttcaagctaaactgggcttctagtggtgctggtgaaaggcgtgctgctgatgatggtcctgagcacacaatatttgttggtgatttagcttctgatgttacagactccatgttggaagaagcattcaaaaccagttatccttcagttagaggagccaaagttgtttttgacaaagtcactgggcgatccaagggatatggttttgtacgttttggagatgaaaatgagcaaacacgtgctatgactgagatgaatggagcgaccttgtctacaaggcaaatgaggcttgggccggcagctaacaagaagaatatgggtacccagcagacatattcaacaaatggttaccagagctcccaaggaaacagtttggagaatgatcccaataatacaacaatctttgtgggcgggttagattccaatgtaaatgaggaccatctaaagcaagtatttactccatatggggaaattggttatgtgaagattcctctaggcaagcgttgtggatttgtccaatttactagcaggtcatctgctgaagaagccatccgtgtgctgaatgggtctcagattggtgggcagcaagttcggctttcatggggccgtactcctcagaacaagcaggctccccagcaggatgccaaccagtggaatggcaactactatggataccaacagggctatgattcttcttactatggtgcacccaatgcacaggatcctagtgcgcaaaactactatggatattctggctatggcaattacgaacagcagcaggagcccccacagcagcagcagcaacccccacaacagcccccacagcagccacaagataacaagttcagtacatcatttatcacacga

SEQ ID NO: 30 - protein, 489 aa, Oryza sativa
  LOC_Os07g33330.1 (RRM1 129-210, RRM2 222-301, RRM3 332-404)
MQQPPPPTMNGGHHAAPPPPQVSGAPPPPHGHYQQQPPPQPYCQQQQPLPPHYYQAGPPHAPPPQQPPAMWGQPPPPPPQYAPPPPQQFQLPHQQYAPPPQHYAPPPPQQQYGAQMAGGPAPGGDEIRSLWIGDLQYWMDESYLSNAFAPMGQQVTSVKVIRNKQSGHSEGYGFIEFQSHAAAEYALANFNGRMMLNVDQLFKLNWASSGAGERRAADDGPEHTIFVGDLASDVTDSMLEEAFKTSYPSVRGAKVVFDKVTGRSKGYGFVRFGDENEQTRAMTEMNGATLSTRQMRLGPAANKKNMGTQQTYSTNGYQSSQGNSLENDPNNTTIFVGGLDSNVNEDHLKQVFTPYGEIGYVKIPLGKRCGFVQFTSRSSAEEAIRVLNGSQIGGQQVRLSWGRTPQNKQAPQQDANQWNGNYYGYQQGYDSSYYGAPNAQDPSAQNYYGYSGYGNYEQQQEPPQQQQQPPQQPPQQPQDNKFSTSFITR

SEQ ID NO: 31 - DNA, 1395 bp, Zea mays
  GRMZM2G127510_T01
atgcagccgccgcaccaaccgccgatgaacgggcaacactcccagcctccgccgcaaggacccgtggtgcccatgcctccgcagcagcaggcgcccccgctgccgtactaccagcagcagcaggcgccgcagtactaccaacaggccctcccgcagccgtgggggcagcagcagcagtacgctgcaccgccgccgcagtacccgcctccgcctcagacgcagcattacgcgacaccaccgcagcagtacgcccctctgccgcagcagcagtacgctcctccaccgcagcagcagtacgctccttcgccatatggtaccacgccgggaagcggtgaagtcaggacgctgtggatcggagatcttcagcactggatggacgagaactacctccactacaacgcctttgcggccgtggcccagcagattgcttctgtgaaaattatacggaacaagcaaactgggcactcagaaggctatggttttattgagttttactctcgagctgctgcagaacatactctgatgaacttcaatgggcagatgatgccgaatgttgagatgacttttaagctgaactgggcttctgctagcactggtgataagcgtggagatagtggttctgatcgcacaatatttgttggtgatttggctcatgatgttactgactccatgttggaagatgtgttcagagctaagtacccttcagttagaggagctaatgttgttgttgataggatgactggatggcccaaaggatttggtttcgtgcgttttggagatctgaatgagcaggcacgtgctatgactgagatgaatggaatgttgttatctacaaggcaaatgaggattggtgctgcagctaacaagaagaatagggatgctcagcagacatatgcaactgacggagcataccagagctctaaaggaaattcttcagagaatgatcctaacaatacaacagtctttgtaggtgggttagattccaatgtaaatgaggagtatctaaggcaaatttttactccgtatggagaaatttcctatgtgaagattcctgtaggcaaacattgtggatttgttcaatttaccagcaggtcatgtgcagaggaagccatccgaatgctgaatgggagtcaggttggtgggcagaaagttcggctttcatggggccgtagtcctcaaaacagacaggcttctcagcatgatgccaacaaccagtataatgggaacagctattatggataccaacagccgggttatgaaggttatggctatggtgcttccagtgcacaagacccaagcatgcaaaactactacggatactctggttgtggtaactatgagcagcagcagccaacacaggaacagcagctgcagcagcctccaccaccacagcac

SEQ ID NO: 32 - protein, 465 aa, Zea mays
  GRMZM2G127510_T01 (RRM1 115-199, RRM2 208-287, RRM3 319-391)
MQPPHQPPMNGQHSQPPPQGPVVPMPPQQQAPPLPYYQQQQAPQYYQQALPQPWGQQQQYAAPPPQYPPPPQTQHYATPPQQYAPLPQQQYAPPPQQQYAPSPYGTTPGSGEVRTLWIGDLQHWMDENYLHYNAFAAVAQQIASVKIIRNKQTGHSEGYGFIEFYSRAAAEHTLMNFNGQMMPNVEMTFKLNWASASTGDKRGDSGSDRTIFVGDLAHDVTDSMLEDVFRAKYPSVRGANVVVDRMTGWPKGFGFVRFGDLNEQARAMTEMNGMLLSTRQMRIGAAANKKNRDAQQTYATDGAYQSSKGNSSENDPNNTTVFVGGLDSNVNEEYLRQIFTPYGEISYVKIPVGKHCGFVQFTSRSCAEEAIRMLNGSQVGGQKVRLSWGRSPQNRQASQHDANNQYNGNSYYGYQQPGYEGYGYGASSAQDPSMQNYYGYSGCGNYEQQQPTQEQQLQQPPPPQH

SEQ ID NO: 33 - DNA, 1509 bp, Zea mays
  GRMZM2G169615_T01
atgcagccgctgcaccaaccgccgatgaacgggcaacacggcccgcctcctccgcagggatccggggttcccacggcttcgcagcagcaggcgccaccgccgtcgtactaccagcagcagcagcagcagcagcaggggccaccgcctcagtactaccagcagggtcccccacagccgtgggcgcagcagcaacagtacgctccaccgccgccgcagtacccgcctcagatgcagcagtacgctccaccaccgcagcagtacgcccctccgccgcagcagcagtacgccgctccgccgcagcagcagtacgccgctccgccgccgcagtacgcgcctccgccgccgcagtacgcgcctccgccgcagcagtacgcgcagccgccgcagtacgcgcagccaccgcagtatgggacaacgccgggaagcggtgaggtcaggaccctgtggattggagatcttcagtactggatggacgagaactatctccactacaacgccttcgcgcctgtggcccagcagattgcctctgtgaaaattatacggaacaagcagactgggcactcagaaggttatggttttattgagttttactctcaagccgctgcagaacatactctgatgaacttcaatgggcagatgatgccgaatattgagatggcttttaagctgaattgggcttctgctagcactggggataagcgtggagataatggttctgaccatgcaatatttgttggtgatttggcccctgatgttacggactccatgttggaagatgtgttcagagctaactatccttcagttagaggagctaaagttgttgttgataggatcactggacggcctaaaggatatgggttcgtgcattttggagatctgaatgagcaggcacgtgctatgaccgagatgaatggaatgatgttatctacaaggaaaatgaggattggggctgcagctagcaagaagaatacagatgctcagcagacatatgcaactaatggtgcataccagagttctcaaggcaattgttcagagaatgatcccaacaatacaacagtctttgtgggtgggttagattccaatgtagacgaggagtatctaaggcaaatttttactccgtacggagaaatttcctatgtgaagattcctgtaggcaagcattgtggatttgttcaatttaccagcaggtcatgtgctgaggaagccatccaaatgctgaatgggagtcagattggtggacagaaagctcggctttcatggggccgtagtactcaaaacagacaggcttctcagcatgatgccaacagccagtataatgggaacaactattatcgataccaacagccgggtaatgaaggttatagctatggtgcacccaatgcacaagacccaagcattcaaaactactatggataccctggttatggtaactatgagcagcagtcaacacaggaacagcagcagcagcagcctccaccagcacaggagcagcctccaccggcaccacag

SEQ ID NO: 34 - protein, 503 aa, Zea mays
  GRMZM2G169615_T01 (RRM1 147-231, RRM2 240-319, RRM3 351-423)
MQPLHQPPMNGQHGPPPPQGSGVPTASQQQAPPPSYYQQQQQQQQGPPPQYYQQGPPQPWAQQQQYAPPPPQYPPQMQQYAPPPQQYAPPPQQQYAAPPQQQYAAPPPQYAPPPPQYAPPPQQYAQPPQYAQPPQYGTTPGSGEVRTLWIGDLQYWMDENYLHYNAFAPVAQQIASVKIIRNKQTGHSEGYGFIEFYSQAAAEHTLMNFNGQMMPNIEMAFKLNWASASTGDKRGDNGSDHAIFVGDLAPDVTDSMLEDVFRANYPSVRGAKVVVDRITGRPKGYGFVHFGDLNEQARAMTEMNGMMLSTRKMRIGAAASKKNTDAQQTYATNGAYQSSQGNCSENDPNNTTVFVGGLDSNVDEEYLRQIFTPYGEISYVKIPVGKHCGFVQFTSRSCAEEAIQMLNGSQIGGQKARLSWGRSTQNRQASQHDANSQYNGNNYYRYQQPGNEGYSYGAPNAQDPSIQNYYGYPGYGNYEQQSTQEQQQQQPPPAQEQPPPAPQ

SEQ ID NO: 35 - DNA, 1218 bp, Oryza sativa
  LOC_Os03g37270.1
atgatgcagccgccgccgccgccgcagtgggcaatggggccgccgcctcctccgcagtacttccaggctggccctccgccgccgccgccacagtacttccagggggcgcatccacccgctgccatgtggggccagcccccgccgccgcaggctgcccctccgccggcgccggctggtggcgcagcaggggacgaggtgaggaccctgtggatcggcgacctccagttctggatggaagagaactacctgtacaactgcttctcccaggccggcgagcttatctcagcaaagataattcggaacaagcaaactgggcaacctgagggttatggtttcattgaatttggcagccatgctatagccgaacaagttctgcaaggctataatggtcaaatgatgcctaatggtaatcaggttttcaaattaaattgggcgacaagtggtgctggcgagaagcgtggagatgatggctcagattatactatatttgttggggatctcgcctcggatgttacagatttaattcttcaagatacattcaaggcccattaccaatcagttaagggtgcaaaagttgtctttgacagaagtactggtcgttcaaaaggctatggatttgttaagtttggagatttggatgaacagacacgtgcaatgactgaaatgaatggacaatattgttctagcaggcctatgcgtattggaccagcatccaacaagaaaaatataggtggccaacaacaaccaagtgctacataccagaatacacaaggaacagattctgatagcgatccaaacaatactactgtatttgttggtggtcttgatccaagtgtgactgatgaggttctgaaacaagccttcagtccatatggagaacttgtctacgtcaaaatacctgtaggaaagcgttgtggatttgttcaatattccaatagggcttcagctgaggaggccataaggatgctaaatggaagccaattaggaggtcagagcataaggctttcatggggtcgtagccctggaaacaagcagcctcagcaagaccagaaccaatggaatgctggctattatggatatcccccccaaggatatgatccatatggttatgttcggccgcctcaagatcctgccatgtacgcttatgcagcatatcctggatacgggaattatcaacaaccagcgccacagcagccccctcaacaggttaaggcactc

SEQ ID NO: 36 - protein, 406 aa, Oryza sativa
  LOC_Os03g37270.1 (RRM1 68-148, RRM2 159-238, RRM3 268-340)
MMQPPPPPQWAMGPPPPPQYFQAGPPPPPPQYFQGAHPPAAMWGQPPPPQAAPPPAPAGGAAGDEVRTLWIGDLQFWMEENYLYNCFSQAGELISAKIIRNKQTGQPEGYGFIEFGSHAIAEQVLQGYNGQMMPNGNQVFKLNWATSGAGEKRGDDGSDYTIFVGDLASDVTDLILQDTFKAHYQSVKGAKVVFDRSTGRSKGYGFVKFGDLDEQTRAMTEMNGQYCSSRPMRIGPASNKKNIGGQQQPSATYQNTQGTDSDSDPNNTTVFVGGLDPSVTDEVLKQAFSPYGELVYVKIPVGKRCGFVQYSNRASAEEAIRMLNGSQLGGQSIRLSWGRSPGNKQPQQDQNQWNAGYYGYPPQGYDPYGYVRPPQDPAMYAYAAYPGYGNYQQPAPQQPPQQVKAL

SEQ ID NO: 37 - DNA, 1215 bp, Zea mays
  GRMZM2G002874_T01
atgatgcagccgccgccgccacatcagcagcagcaatgggcaatggcgcccccgcccccgccgcagtactaccaggcggggcaccctccgccgccgcccccgcagttctaccaggcgggccctccgcctcccgctatgtggggccaaccgccaccgcaggcggcggcggcgccggcgccggccggcggcggggcgggggacgaggcgaggaccctctggatcggggacctgcagtactggatggatgagaactacctctatagctgcttctcccaggctggcgaggttatttccgtgaagataattcggaacaagcagactgggcaacctgagggttatggttttattgaattcagcaaccatgctgtagccgaacaagttctgcagaactataatggtcaaatgatgcccaatgttaatcaacctttcaaattgaattgggctaccagtggggctggtgagaaacgtggagacgatggttcagattatactatatttgttggggacttggcctcggatgttacagatttcattctacaagatacgttcaagagtcgttatccatcagttaagggtgcaaaagttgtctttgacagaactactggccgttcgaaaggctatggttttgtaaagtttgcagattcggatgaacagacacgggcaatgactgaaatgaatggacaatactgttctagcagggccatgcgccttggaccagcatccaacaagaagaatactggtggaccacaaccatcgagtgctatttaccagaacacccaaggaactgattctgatagcgatccgaacaatactactgtatttgttggcggccttgacccgagtgtgactgacgagcttctgaagcaaactttcagtccatatggagagcttctctatgtcaaaatacctgtaggaaagcgctgcggatttgtccaatattctaacagggcatcagctgaggaggccataagggtgctaaatggaagccagttgggaggtcagagcataaggctctcatggggccgtagccctgcaaacaagcagcctcagcaagagcagagccaatggagcggtggtggctattatgggtatccccaaggatacgatccatatggctatgctcggccccctcaagatcctgccatgtacgcctacgcagcatatccagggtatggaaattaccagcaacagccaccacagcagcccccgccacaa

SEQ ID NO: 38 - protein, 406 aa, Zea mays
  GRMZM2G002874_T01 (RRM1 71-151, RRM2 162-241, RRM3 271-343)
MMQPPPPHQQQQWAMAPPPPPQYYQAGHPPPPPPQFYQAGPPPPAMWGQPPPQAAAAPAPAGGGAGDEARTLWIGDLQYWMDENYLYSCFSQAGEVISVKIIRNKQTGQPEGYGFIEFSNHAVAEQVLQNYNGQMMPNVNQPFKLNWATSGAGEKRGDDGSDYTIFVGDLASDVTDFILQDTFKSRYPSVKGAKVVFDRTTGRSKGYGFVKFADSDEQTRAMTEMNGQYCSSRAMRLGPASNKKNTGGPQPSSAIYQNTQGTDSDSDPNNTTVFVGGLDPSVTDELLKQTFSPYGELLYVKIPVGKRCGFVQYSNRASAEEAIRVLNGSQLGGQSIRLSWGRSPANKQPQQEQSQWSGGGYYGYPQGYDPYGYARPPQDPAMYAYAAYPGYGNYQQQPPQQPPPQQ

SEQ ID NO: 39 - DNA, 1245 bp, Arabidopsis thaliana
  AT4G27000.1
atgatgcagcagccacctccagcttccaacggtgctgcaacagggccagggcagattccttccgaccaacaagcttacctccagcagcagcagtcgtggatgatgcagcaccagcagcaacaacaaggtcagccgcctgcaggatggaatcagcagtctgcaccgtcttctggtcaaccacagcagcagcagtatggtggtggtggatctcagaatccaggatcagctggtgagatccggtccctgtggatcggtgacttgcagccatggatggatgagaactatctcatgaacgtctttggtcttactggcgaggctacagcagctaaagttattcgcaataaacagaacggatattcagaaggttatggctttattgagtttgtgaaccatgctacagctgagaggaatttacagacttacaatggtgctccgatgccgagcagtgagcaggccttcaggttgaactgggctcagcttggagctggagagagacgccaggctgaagggcctgagcacacagtttttgttggagacttggcacctgatgttaccgaccacatgcttactgaaacgtttaaagctgtgtattcctctgtcaagggagctaaagttgtgaatgataggactactggacggtccaagggttatggatttgtcaggtttgcggatgaaagtgagcagattcgtgccatgactgaaatgaatggtcaatactgctcatcaaggcctatgcgtactggtcctgctgccaacaagaagcctcttacaatgcaaccagcttcatatcagaacactcaaggaaattcaggagaaagtgatccaactaacacaacaatttttgttggagctgtggatcaaagtgtaacagaagatgatttgaagtcagtttttggtcaatttggtgaactagttcatgtgaaaatacccgcaggaaaacgttgcggatttgttcaatacgccaatagggcatgtgctgagcaagcactttctgtgttgaacggaacacaacttgggggacaaagcattcgtctttcatggggtcgcagtccttccaacaaacagactcaacctgatcaagcccagtatggtggtggtggaggatactatgggtatcctcctcaaggatatgaagcatacggatatgcacctcctcctcaggaccctaacgcctactacggtggttatgctgggggcggctatggaaactaccagcagcctggtggataccagcagcaacagcag

SEQ ID NO: 40 - protein, 415 aa, Arabidopsis thaliana
  AT4G27000.1 (RRM1 81-161, RRM2 172-251, RRM3 278-350)
MMQQPPPASNGAATGPGQIPSDQQAYLQQQQSWMMQHQQQQQGQPPAGWNQQSAPSSGQPQQQQYGGGGSQNPGSAGEIRSLWIGDLQPWMDENYLMNVFGLTGEATAAKVIRNKQNGYSEGYGFIEFVNHATAERNLQTYNGAPMPSSEQAFRLNWAQLGAGERRQAEGPEHTVFVGDLAPDVTDHMLTETFKAVYSSVKGAKVVNDRTTGRSKGYGFVRFADESEQIRAMTEMNGQYCSSRPMRTGPAANKKPLTMQPASYQNTQGNSGESDPTNTTIFVGAVDQSVTEDDLKSVFGQFGELVHVKIPAGKRCGFVQYANRACAEQALSVLNGTQLGGQSIRLSWGRSPSNKQTQPDQAQYGGGGGYYGYPPQGYEAYGYAPPPQDPNAYYGGYAGGGYGNYQQPGGYQQQQQ

SEQ ID NO: 41 - DNA, 1161 bp, Arabidopsis thaliana
  AT5G54900.1 (RBP45A, G1940)
atgcagcaaccaccgtcaaacgccgccggagctggacagataccatcaggacaacagcatttgtggatgatgatgcaacagcagcagcagcagcagcagatgcagttgtctgcggcgccactaggtcaacatcagtacggtattggatctcagaatccaggatccgctagcgatgttaagtcgttgtggatcggagacttgcagcaatggatggacgagaactacatcatgagcgtctttgctcagtctggcgaggctacatcagctaaagtcattcgtaataagctgacgggacaatctgaaggttatggattcattgagttcgtcagccactctgtagcagagcgggttttgcagacttacaatggtgctcccatgccgagcactgaacagacgtttaggctcaactgggctcaggctggggctggagagaaacgattccagactgaagggcctgaccataccattttcgtaggtgacttggcacctgaggtgactgactatatgctctcggacacattcaagaatgtgtatgggtctgtcaaaggggctaaagttgtgcttgacaggaccactggaaggtccaaggggtatgggtttgttaggtttgcggatgaaaatgagcagatgcgtgccatgactgaaatgaatggtcaatactgctcgacaaggcctatgcgtattggtccggctgccaataagaatgctcttccgatgcaaccagctatgtatcaaaacactcaaggagcaaatgctggagataatgatcctaataacacaacaatttttgttggaggtctggatgctaatgttacagacgatgaattaaagtcaatttttggtcaatttggtgaacttcttcatgtgaaaatacctccaggaaaacgttgtggattcgttcaatatgccaacaaggcgtctgcagagcatgcactttcggtgctgaatggaacacaattaggtggacaaagcatccgtctttcgtggggacgtagtccaaacaagcagtctgatcaagcgcaatggaacggtggtggatactatggataccctccacagccacagggcggctatggttatgcagctcaaccaccaactcaagaccctaatgcgtactatggtggttacactggctatggcaactatcagcagcaacgtcag

SEQ ID NO: 42 - protein, 387 aa, Arabidopsis thaliana
  AT5G54900.1 (G1940, RRM1 61-141, RRM2 153-232, RRM3 260-332)
MQQPPSNAAGAGQIPSGQQHLWMMMQQQQQQQQMQLSAAPLGQHQYGIGSQNPGSASDVKSLWIGDLQQWMDENYIMSVFAQSGEATSAKVIRNKLTGQSEGYGFIEFVSHSVAERVLQTYNGAPMPSTEQTFRLNWAQAGAGEKRFQTEGPDHTIFVGDLAPEVTDYMLSDTFKNVYGSVKGAKVVLDRTTGRSKGYGFVRFADENEQMRAMTEMNGQYCSTRPMRIGPAANKNALPMQPAMYQNTQGANAGDNDPNNTTIFVGGLDANVTDDELKSIFGQFGELLHVKIPPGKRCGFVQYANKASAEHALSVLNGTQLGGQSIRLSWGRSPNKQSDQAQWNGGGYYGYPPQPQGGYGYAAQPPTQDPNAYYGGYTGYGNYQQQRQ

SEQ ID NO: 43 - DNA, 1290 bp, Populus trichocarpa
  POPTR_0001s45000.1
atgatgcaacaaccaggaatcgccggagcgggtgtcccgcaaccagatcaacaacaacaataccaacagcaatggatgatgcagcaacagcaacaatcgcaacccgtacctcctcctgctggatggactccgccgcctgttcctcctccgtcccagtatggttcagccgccggaagtgctgctgttggagacgagatcaagtcgttgtggatcggggatttgcagcagtggatggatgagaattatattctcagcatcttttctaccactggagaggttgtccaagctaaggttattcgtaataagcaaacaggttacccagagggttatggttttattgaatttgttagtcatgctgcagcagagaggattttgcaaacatacaatgggacaccaatgccaaacagtgagcagactttccggctgaactgggctaccctcggtgccggcgagaggcgccaagatgatgggcctgattatacagttttcattggagatttggctgctgatgtcaatgattacctcctacaagaaacatttagaaatgtttactcatccgtgaaaggtgcaaaagttgttactgatagagttactggacgttcaaagggatatggatttgttagatttgctgatgaaaatgaacaaatgcgtgccatggttgagatgaacggacaatactgctctactaggcctatgcggattggaccagcggccacaaagaaacctttgacccagcaatatcagaaagctgcttaccagagtcctcaaggaaatcagggggagagtgatccaaataacacaacaatatttgttggtgctttggatccaagtgtgactgatgacactttgagagcagtgtttagtaaatatggtgagctagtgcatgtgaaaatacctgcaggcaagcgttgtggattcgttcagtttgctaatcgcacttgtgcggagcaagcactatcgatgctgaacggaactcagatagctggtcaaaatattcgactctcatggggccgtagtccttctaacaaacaggctcagccagaccaaagccagtggaacggtggtggatattatggatatccacaaggatatgatgcatatggatatgctgctgctgctgctgctgccgccgccgctccccaagaccctagcatgtattatggaggatatcctggatatggaaactaccagcaaccaggagcttaccaacagcaaccgggagcttaccaacagcaaccgggagcataccaacagcaacccggagcttaccaacagcaacagcaggtagag

SEQ ID NO: 44 - protein, 430 aa, Populus trichocarpa
  POPTR_0001s45000.1 (RRM1 68-147, RRM2 159-238, RRM3 267-339)
MMQQPGIAGAGVPQPDQQQQYQQQWMMQQQQQSQPVPPPAGWTPPPVPPPSQYGSAAGSAAVGDEIKSLWIGDLQQWMDENYILSIFSTTGEVVQAKVIRNKQTGYPEGYGFIEFVSHAAAERILQTYNGTPMPNSEQTFRLNWATLGAGERRQDDGPDYTVFIGDLAADVNDYLLQETFRNVYSSVKGAKVVTDRVTGRSKGYGFVRFADENEQMRAMVEMNGQYCSTRPMRIGPAATKKPLTQQYQKAAYQSPQGNQGESDPNNTTIFVGALDPSVTDDTLRAVFSKYGELVHVKIPAGKRCGFVQFANRTCAEQALSMLNGTQIAGQNIRLSWGRSPSNKQAQPDQSQWNGGGYYGYPQGYDAYGYAAAAAAAAAAPQDPSMYYGGYPGYGNYQQPGAYQQQPGAYQQQPGAYQQQPGAYQQQQQVE

SEQ ID NO: 45 - DNA, 1212 bp, Populus trichocarpa
  POPTR_0011s14150.1
atgatgcaacagcccggagtcgccggagtgggggccccacaaccagatcaacaacaacaataccaacaacaacagcagcaatggatgatgcagcaacagcaacaatcgcaaccggtgcctcctcctgctggctggaatccgccgcctgttcctcctccgacccagtacggtgcagccgccggaagtggaggagatggagacgagattaagtcgttgtggatcggggatttgcagcagtggatggatgagaattatcttcttagcatcttctctgcaactggagagattgttcaagctaaggttattcgtaataagcaaacgggttatccagagggttatggttttattgagtttgtaagtcgtgctgcagcagagagaattttgcagacatacaatggcacaccaatgccaaatagtgagcaggctttccggctgaactgggcaacccttggtgctggtgagaggcggcaagatgatgggcctgattttacagtttttgttggagatttggctgctgatgtcaacgattaccttctacaagaaacatttagaaatgtgtacccatctgtgaaaggtgcaaaagttgttactgatagggtcactggacgttccaagggatatggatttattaggtttgctgatgaaaatgaacaaaggcgtgccatggttgagatgaatggacaatactgctctaccaggcccatgcggattggaccagctgccacgaagaaacccttgacccagcagtatcagaaagctacttaccagaatcctcaaggaaatcagggagagaatgatccaaataacacaacaatatttgtcggggccttggatccaagtgtgactgatgacactttgagagcagtgtttagtaaatatggcgagctagtgcacgtgaaaatacctgcaggcaagcgttgtggattcgttcagtttgctaatcgaactagcgcggagcaagcactatcaatgttgaacggaacccagatagctggtcaaaatatccgtctctcatggggccgtagtccttctaacaaacaggttcagccagatcaaagccagtggaatggcggtggatattatggatatccacaaggatatgatgcatatggatatgctgctgctgctccccaagaccctaacatgtattatggaggctatcctggatatggaaactaccagcaaccgggagcttaccaacagcaacagcag

SEQ ID NO: 46 - protein, 404 aa, Populus trichocarpa
  POPTR_0011s14150.1 (RRM1 71-151, RRM2 162-241, RRM3 270-342)
MMQQPGVAGVGAPQPDQQQQYQQQQQQWMMQQQQQSQPVPPPAGWNPPPVPPPTQYGAAAGSGGDGDEIKSLWIGDLQQWMDENYLLSIFSATGEIVQAKVIRNKQTGYPEGYGFIEFVSRAAAERILQTYNGTPMPNSEQAFRLNWATLGAGERRQDDGPDFTVFVGDLAADVNDYLLQETFRNVYPSVKGAKVVTDRVTGRSKGYGFIRFADENEQRRAMVEMNGQYCSTRPMRIGPAATKKPLTQQYQKATYQNPQGNQGENDPNNTTIFVGALDPSVTDDTLRAVFSKYGELVHVKIPAGKRCGFVQFANRTSAEQALSMLNGTQIAGQNIRLSWGRSPSNKQVQPDQSQWNGGGYYGYPQGYDAYGYAAAAPQDPNMYYGGYPGYGNYQQPGAYQQQQQ

SEQ ID NO: 47 - DNA, 1230 bp, Solanum lycopersicum
  Solyc07g064510.2.1
atgatgccacaaagtggagttgctcagccagcaatggcacctatgtcaatggatcagtatcagcagcaagctccgccgacgcagcagcaacaacaatggatgatgcaacctccgcaagctcaacaacctcaatttcaaccttcttggggtcagcagcaacaacagccatcgcaaactatgtctcaacagtatgttgcgactaattctagccctagctcgaatgttaatccaaatgaggttaggtctctttggattggggacttgcagtattggatggatgagagttatctctccacttgtttctatcacaccggcgagcttgtttctgctaaggtcatcaggaacaagcaaagtggccagtctgaaggttatggattcctcgaattcaggagtcatgcggctgcagaaactgttttacaaacatataatggcgccttgatgccaaatgtggaacagaatttccgtatgaactgggcatctcttggtgccggtgagaggcgagatgattcacccgagtacacaatatttgttggtgatttggctgctgatgtgacggattatgtgctacaagagacattcaaacccgtgtattcatcagtaaaaggtgcaaaagttgtaacagatagaattactggacgtaccaagggatatggatttgtcaagttctctgatgagagtgaacaattgcgtgctatgactgaaatgaatggtgtactttgttcatctaggcccatgaggattggcccggctgcaaacaagaaaccaatgggtaccccccagaaagctacctaccaaaatcctcaagctactcaaggcgaaagtgaccccaataatacaactatatttgttggtggtttggatcccagtgttgcagaagagcatttgcgacaagttttctccccatatggtgaattggttcacgtgaagatagtggctggaaagcgctgtggctttgttcagtttggtagtagagcttctgctgagcaggctttgtcaagcttgaatggcacacaattgggaggacaaagcattcggctttcttgggggcgtagcccctctaacaaacagtccgatcaggctcaatggggtggaagtgccggtgctggtgctggtgcatattatgggtatgcccaaggatatgaggcttatggatatgctcctcccgctcaggaccctaatatgtattatgggaattacccaggatatgggaattatcagcagccacagcag

SEQ ID NO: 48 - protein, 410 aa, Solanum lycopersicum
  Solyc07g064510.2.1 (RRM1 82-162, RRM2 172-251, RRM3 279-351)
MMPQSGVAQPAMAPMSMDQYQQQAPPTQQQQQWMMQPPQAQQPQFQPSWGQQQQQPSQTMSQQYVATNSSPSSNVNPNEVRSLWIGDLQYWMDESYLSTCFYHTGELVSAKVIRNKQSGQSEGYGFLEFRSHAAAETVLQTYNGALMPNVEQNFRMNWASLGAGERRDDSPEYTIFVGDLAADVTDYVLQETFKPVYSSVKGAKVVTDRITGRTKGYGFVKFSDESEQLRAMTEMNGVLCSSRPMRIGPAANKKPMGTPQKATYQNPQATQGESDPNNTTIFVGGLDPSVAEEHLRQVFSPYGELVHVKIVAGKRCGFVQFGSRASAEQALSSLNGTQLGGQSIRLSWGRSPSNKQSDQAQWGGSAGAGAGAYYGYAQGYEAYGYAPPAQDPNMYYGNYPGYGNYQQPQQ

SEQ ID NO: 49 - DNA, 1191 bp, Eucalyptus grandis
  Eucgr.F03462.1
atgatgcagcagccggtccccggagccgtccccgaccagcagcagcagtaccagcagcagcagcagcagcagtggatgatgatgcagcaggccgcccagcccgtgcccccgccggtgggctggaccccgcagccggtcccgccgcccatggcggcccagtcgatggccggcggcgcggcggccgagatcaagtcgctctggatcggcgacctgcagcctcacatggacgagacctatctcctcaactgcttcgcccactccggggaggttctctcagctaaggtgattagaaataagcagactgctctgcccgagggttacggtttcattgaatttatgacccgtgcagcagcagagaggattttgcagacgtacaatggcacattgatgccaaattctgaccagaatttccgactgaactgggctacacttggtcctggtgagaggcgtcaagatgagggtcctgactatacaatttttgttggagatctggctgctgatgtaacagatcacatgctacaggagacatttagagctcactatccatctgtgaaaggtgccaaaatagttatcgacaggacaactggccgttctaagggctatgggtttgttaggttcggcgatgagactgagcagttacgggccatgaccgaaatgaatggcatgtattgttcttctcgccccatgaggattgggcccgctgctaacaagaagcctattgctacccagcaatatcagagtgcatcttaccagaacagtcaaggaaaccaaggggagaatgatccaaataatacaactatatttgtcgggggtctggatccaagtgtatcagatgaccttttgaggcaagtattcagtcaatatggagagttgcatcatgtgaaaattccacctggcaaacgttgcggttttgttcaattcacaagcagagcttgtgctgagcaagccttgttgatgttgaatggaacccagttgggaggacaaagcattcgactgtcatgggggcggagtccctcgaacaagcaggctcagccggagcaggcacagtggaatggtggtggatattatggatatccacagggatatgaagcatatggttatgcccctcctacccaggaccctaatatgttctatggaggttatgctgggtataattatcagcagcctgtaacctaccagcagccacagcag

SEQ ID NO: 50 - protein, 397 aa, Eucalyptus grandis
  Eucgr.F03462.1 (RRM1 65-145, RRM2 156-235, RRM3 265-337)
MMQQPVPGAVPDQQQQYQQQQQQQWMMMQQAAQPVPPPVGWTPQPVPPPMAAQSMAGGAAAEIKSLWIGDLQPHMDETYLLNCFAHSGEVLSAKVIRNKQTALPEGYGFIEFMTRAAAERILQTYNGTLMPNSDQNFRLNWATLGPGERRQDEGPDYTIFVGDLAADVTDHMLQETFRAHYPSVKGAKIVIDRTTGRSKGYGFVRFGDETEQLRAMTEMNGMYCSSRPMRIGPAANKKPIATQQYQSASYQNSQGNQGENDPNNTTIFVGGLDPSVSDDLLRQVFSQYGELHHVKIPPGKRCGFVQFTSRACAEQALLMLNGTQLGGQSIRLSWGRSPSNKQAQPEQAQWNGGGYYGYPQGYEAYGYAPPTQDPNMFYGGYAGYNYQQPVTYQQPQQ

SEQ ID NO: 51 - DNA, 1215 bp, Arabidopsis thaliana
  AT1G11650.2
atgatgcagcagccaccacccggaggtatccttccacatcacgctcctcctccttctgcgcaacaacagtacggttaccaacaaccttacgggattgctggagctgctccaccaccaccacagatgtggaatcctcaagcggcggcgccgccatcagttcagcctacgaccgctgacgagatccggactctttggatcggggacttacagtattggatggatgagaatttcctctacggttgctttgctcataccggagagatggtttctgctaaagtgattcgtaacaagcaaaccggtcaagttgaaggatacggtttcattgaattcgcatctcatgctgctgctgaaagagttctacaaacattcaacaacgctcctatcccgagctttcctgatcagctctttagactgaactgggcatcattgagttcaggagataaacgagacgattcaccggactacacgatatttgtcggtgatctggctgctgatgttacggattatatcttacttgagacgttcagagcctcttatccgtcagtgaagggtgcaaaggttgttattgacagagtcactggacgtacaaaaggatatgggtttgttaggttttctgatgaaagtgaacagatccgtgctatgacggagatgaatggcgttccttgttctactagacctatgagaattggtcccgctgctagcaagaaaggtgtaactggtcaaagagattcataccagagctctgctgcaggggtaacaactgataatgatccaaataacacaactgtttttgttggtggattagatgcatctgtcacggatgatcatctgaagaatgtctttagccaatatggtgagattgtgcatgtgaaaatacccgctggaaagcgctgtggattcgttcagttttccgagaagagctgtgcagaggaagctcttagaatgctgaatggagtgcaattaggcggaacaaccgtcaggctctcatggggccgaagtccttcgaacaaacagtcgggggatccgagccagttttactacggtgggtatggacaaggacaggagcagtatgggtacacgatgcctcaagaccctaatgcatattacggaggctactctggtggaggatacagcggtggttaccagcagacaccacaggcaggacagcaaccaccacaacagccaccacagcagcaacaagtcgggtttagctac

SEQ ID NO: 52 - protein, 405 aa, Arabidopsis thaliana
  AT1G11650.2 (RRM1 63-144, RRM2 157-233, RRM3 261-333)
MMQQPPPGGILPHHAPPPSAQQQYGYQQPYGIAGAAPPPPQMWNPQAAAPPSVQPTTADEIRTLWIGDLQYWMDENFLYGCFAHTGEMVSAKVIRNKQTGQVEGYGFIEFASHAAAERVLQTFNNAPIPSFPDQLFRLNWASLSSGDKRDDSPDYTIFVGDLAADVTDYILLETFRASYPSVKGAKVVIDRVTGRTKGYGFVRFSDESEQIRAMTEMNGVPCSTRPMRIGPAASKKGVTGQRDSYQSSAAGVTTDNDPNNTTVFVGGLDASVTDDHLKNVFSQYGEIVHVKIPAGKRCGFVQFSEKSCAEEALRMLNGVQLGGTTVRLSWGRSPSNKQSGDPSQFYYGGYGQGQEQYGYTMPQDPNAYYGGYSGGGYSGGYQQTPQAGQQPPQQPPQQQQVGFSY

SEQ ID NO: 53 - DNA, 1227 bp, Populus trichocarpa
  POPTR_0004s01690.1
atgatgcagcaaccaggaccaggaggagccatgctaccccaacaacaacaaccaccacagcaataccagcaacctccttacatgatgatgatgccgccaccaccaatggctcaaacccaacctccaccaccacacatgtgggctcaacatcaggcccatcaggcttctattccaccaccacagcaacaacagggacagggacaacctcctgctactgctgatgaggtcaggactctttggattggtgacttgcagtactggatggatgagaactatattgctagctgttttgctcatactggagaggttgcttctgtgaaaatcattcgtaataagcaaacttctcaaatcgaaggttatggatttattgagatgaccagtcatggggctgcagaaaggatattgcagacttataatggtaccccaatgccaaatggcgagcagaactttaggctgaactgggcttcttttagtgggggtgataagcgtgatgattctcctgacttcactatatttgtgggagacttggctgctgatgttacagatttcatgctccaagagacattcagggcccactttccctcagtgaagggtgcaaaggtggtgattgataggctcactggacgcacaaagggttatggatttgttcgttttggagatgaaagtgaacagctacgtgctatgaccgagatgaatggggcattttgttcgacaaggcctatgcgagtagggcttgcttcaaacaagaaggctgtggttggtcagcaatatccaaaagcttcatatcagaatcctcagcctcagaacgacggcgaccctaataatacaactatatttgttggtaatttggattctaatgttatggatgatcatttgaaagaactctttggccaatatggacaattattgcatgtgaagatacctgcaggcaagagatgtgggtttgttcagtttgctgacaggagctctgcagaagaagcactgaaaatgttaaatggagctcagttgagcggacagaatattcgattgtcatggggccgtaatccttcaaataaacaggctcagccagatgcaaaccagtatggtggtggatactatggatatggacaacagggatatgaaaattatgggtatgccccagctactcaggaccccaatatgtactacggaggttatcctggttatgggaactatcagcagggccagcagcagcaagtaggatatagc

SEQ ID NO: 54 - protein, 409 aa, Populus trichocarpa
  POPTR_0004s01690.1 (RRM1 78-158, RRM2 168-247, RRM3 276-348)
MMQQPGPGGAMLPQQQQPPQQYQQPPYMMMMPPPPMAQTQPPPPHMWAQHQAHQASIPPPQQQQGQGQPPATADEVRTLWIGDLQYWMDENYIASCFAHTGEVASVKIIRNKQTSQIEGYGFIEMTSHGAAERILQTYNGTPMPNGEQNFRLNWASFSGGDKRDDSPDFTIFVGDLAADVTDFMLQETFRAHFPSVKGAKVVIDRLTGRTKGYGFVRFGDESEQLRAMTEMNGAFCSTRPMRVGLASNKKAVVGQQYPKASYQNPQPQNDGDPNNTTIFVGNLDSNVMDDHLKELFGQYGQLLHVKIPAGKRCGFVQFADRSSAEEALKMLNGAQLSGQNIRLSWGRNPSNKQAQPDANQYGGGYYGYGQQGYENYGYAPATQDPNMYYGGYPGYGNYQQGQQQQVGYS

SEQ ID NO: 55 - DNA, 1281 bp, Eucalyptus grandis
  Eucgr.D01310.1
atgatgcaaccatctgcaaccggcatggtccctcccccgctcgatcagcagcagcagcagcagcagcagcagcagtaccaataccagcagcagccgccgcagcaaccgccgcagcagccgtcgcagcagccgccgccgccgcagccctacatgatgatgccccccgccggccacccttcccaggccccgccgccgccgcagatgtgggccgcccaccagcccctccccgcgatgccccagcaggccgctcccggcggcggcggcgacgaggtgcgcaccctctggatcggggacctgcagtactggatggacgaggcctatctcggcacctgcttcgccgccaccggagaggtggccaacgtaaaggttatcaggaacaagcagacaatgcaaccagaaggttatggtttcattgagttttacactcgggcagcagccgaaagagtactgcagacgtacaatggtgcaatcatgcccaatggtggacagagctttagactgaactgggctagtgctggtgaaaagcgtgcggacgatacccctgactatacaatttttgtgggggacttggcttcagatgttacggactatatgttgcaagagatgttcagaggacgctatccttctgttaggagtgcaaaagtagtaatggacaggcttacgagccgtacaaagggttatgggtttgttaagttcggagatgaaagtgagcagatacgtgctatgagtgagatgaatggagtcttcctttcaacaagaccgatgagaattggacttgccacaaataagaagatcgctactgggcaacagtatcaaaaagcatcttaccagaacactcaagttactccaaatgagactgatcccaataataaaactgtatttgttggtggtctagatcccaatgtgactgatgaccacttgagacaagtttttggacaatacggcgaaattgtccaggtgaagataccacctggaaagcggtgtggatttgttcagtttgctgataggagctgcgcggaagaagctttgcgaatgttgaatggaacccagctgggaggacagaacattaggctttcatggggccggagtcctgcaaacaaacagccacagtcagatcctagccagtatggagggtattacggatatgctgctggttatgaaaactatggatatggtgcagcttcgcaagatgctaacatgtactatggcggttatgctggatatgcaaattatcagcagccccagcagcaacagcagcaacagcaacaattaggttacagt

SEQ ID NO: 56 - protein, 427 aa, Eucalyptus grandis
  Eucgr.D01310.1 (RRM1 93-171, RRM2 182-261, RRM3 291-363)
MMQPSATGMVPPPLDQQQQQQQQQQYQYQQQPPQQPPQQPSQQPPPPQPYMMMPPAGHPSQAPPPPQMWAAHQPLPAMPQQAAPGGGGDEVRTLWIGDLQYWMDEAYLGTCFAATGEVANVKVIRNKQTMQPEGYGFIEFYTRAAAERVLQTYNGAIMPNGGQSFRLNWASAGEKRADDTPDYTIFVGDLASDVTDYMLQEMFRGRYPSVRSAKVVMDRLTSRTKGYGFVKFGDESEQIRAMSEMNGVFLSTRPMRIGLATNKKIATGQQYQKASYQNTQVTPNETDPNNKTVFVGGLDPNVTDDHLRQVFGQYGEIVQVKIPPGKRCGFVQFADRSCAEEALRMLNGTQLGGQNIRLSWGRSPANKQPQSDPSQYGGYYGYAAGYENYGYGAASQDANMYYGGYAGYANYQQPQQQQQQQQQLGYS

SEQ ID NO: 57 - DNA, 1191 bp, Glycine max
  Glyma07g38940.1
atgatgcaggctggacccggcggcatggcccaacaagcgaaccaacaatacgcacagcaacagcaacaaccctacatgatgatgccgccgcagcctcagccccctcagatgtgggccacatcggcccagcctccgtcccagtcggtggctcctccgcaacccaccagcgccgatgaggtccgtaccctctggatcggtgatttgcagtactggatggacgaaaattatctctacacctgtttggcacacaccggcgaggtggcttcagttaaagtcattcggaacaaacaaactagtcaatcggagggatatgggtttattgagtttactagtcgtgctggtgctgagagagtccttcaaacatacaatggcaccattatgccaaatggcgggcagaacttcagattgaactgggcaactcttagtgcaggtgagaggcgtcacgatgatagcccagatcacaccatatttgttggagacctggctgccgatgttacggattatcttcttcaagagacatttcgggcacgatatccctcaattaagggggccaaagttgtaattgataggctaactggacggacaaagggttatggttttgttaggtttggagatgagagtgaacaggttagagctatgactgaaatgcaaggggttctttgttcaacaaggcccatgcgaattggaccagcctctaataaaaaccctagcactcagtctcagccaaaagcatcatatcagaatcctcaaggggcacagaacgagcatgatccaaataatacaactatttttgtcggcaatttggatcctaacgtcacggatgaccatttgagacaagtttttgggcattatggagagttagttcatgtgaagattccagctggcaagcgatgtggatttgtccaatttgcggaccggagctgtgcggaagaggcactgcgggttttgaatggcacacttctaggcggacaaaatgttaggctttcatgggggcgaagtccttcaaacaaacaggctcaaccagatgcaaaccagtggaatggtagtggtggtggatactacggatatgctcaggggggctatgaaaattatggttatgcccctgctggacaggaccccaatatgtatggcagttatcctgggtatgcgaattaccaacctccccagcaacagcagcaaataggatatagc

SEQ ID NO: 58 - protein, 397 aa, Glycine max
  Glyma07g38940.1 (RRM1 62-142, RRM2 153-232, RRM3 261-333)
MMQAGPGGMAQQANQQYAQQQQQPYMMMPPQPQPPQMWATSAQPPSQSVAPPQPTSADEVRTLWIGDLQYWMDENYLYTCLAHTGEVASVKVIRNKQTSQSEGYGFIEFTSRAGAERVLQTYNGTIMPNGGQNFRLNWATLSAGERRHDDSPDHTIFVGDLAADVTDYLLQETFRARYPSIKGAKVVIDRLTGRTKGYGFVRFGDESEQVRAMTEMQGVLCSTRPMRIGPASNKNPSTQSQPKASYQNPQGAQNEHDPNNTTIFVGNLDPNVTDDHLRQVFGHYGELVHVKIPAGKRCGFVQFADRSCAEEALRVLNGTLLGGQNVRLSWGRSPSNKQAQPDANQWNGSGGGYYGYAQGGYENYGYAPAGQDPNMYGSYPGYANYQPPQQQQQIGYS

SEQ ID NO: 59 - DNA, 1206 bp, Glycine max
  Glyma17g01800.1
atgatgcaggctggacccggcggcatggcccaacaagcgaaccagcaatacgcacagcaacagcaacaacaacaacaacaagcctacatgatgatgccgccgcagcctcagccccctcagatgtgggccccatcggcccagcctccgtcccaatcggtagctcctccgcaacccaccagcgccgatgaggtccgtaccctctggatcggcgatttgcagtactggatggacgaaaattatctctatacctgtttcgcacacaccggcgagctggcttcagttaaagtcattaggaacaaacaaactagtcaatcggagggatatgggtttattgagtttactagtcgagctggtgccgagagagtccttcaaacatacaatggcaccattatgccgaatggcgggcagaacttcagattgaactgggcaacttttagtgcaggtgagaggcgtcatgatgacagcccggatcacaccatatttgttggagacctggctgcagatgttacggattatcttctgcaagagacatttcgggcacgatatccttcagctaagggggccaaagttgtaattgataggttaactggacggacaaagggctatggttttgttaggtttggagatgagagtgaacaggttagggctatgagtgaaatgcaaggggttctttgttcaacaaggcccatgcgaattggaccagcctctaataaaaaccctagcactcagtctcagccaaaagcatcatatcagaatcctcaaggggcacagaacgagcatgatccaaataataccactatttttgttgggaatttggatcctaacgtcacggatgatcatctgagacaagtttttgggcagtatggggagttagttcatgtgaagattccagctggcaagagatgtggatttgtccaatttgcggacaggagctgtgcagaagaggcactgcgggttttgaatggcacacttttaggcggacaaaatgttcggctttcatggggccgaagtccttcaaacaaacaggctcaaccagatgcaaaccagtggaatggtagtggtggtggtggatactatggatatgcgcaggggggctatgaaaattacggttatgcccctgctggacaggatcccaatatgtatggcagttatcctggctatgcaaattaccaaccaccccagcaaccgcagcaaataggatatagc

SEQ ID NO: 60 - protein, 402 aa, Glycine max
  Glyma17g01800.1 (RRM1 66-146, RRM2 157-236, RRM3 265-337)
MMQAGPGGMAQQANQQYAQQQQQQQQQAYMMMPPQPQPPQMWAPSAQPPSQSVAPPQPTSADEVRTLWIGDLQYWMDENYLYTCFAHTGELASVKVIRNKQTSQSEGYGFIEFTSRAGAERVLQTYNGTIMPNGGQNFRLNWATFSAGERRHDDSPDHTIFVGDLAADVTDYLLQETFRARYPSAKGAKVVIDRLTGRTKGYGFVRFGDESEQVRAMSEMQGVLCSTRPMRIGPASNKNPSTQSQPKASYQNPQGAQNEHDPNNTTIFVGNLDPNVTDDHLRQVFGQYGELVHVKIPAGKRCGFVQFADRSCAEEALRVLNGTLLGGQNVRLSWGRSPSNKQAQPDANQWNGSGGGGYYGYAQGGYENYGYAPAGQDPNMYGSYPGYANYQPPQQPQQIGYS

SEQ ID NO: 61 - DNA, 1227 bp, Glycine max
  Glyma13g27570.1
atgatgcagcagccaggacccggcatggcacctcccaccatgggccagcagccgccgcaacagtaccagcagcctccgccgcagcagcagcaaccctacgtcatgatgccgccgcaggcccaggccccgcaggccatgtgggccccctccgcccagcctccgcctcagcagcagcccgccagcgccgacgaggtccgaaccctctggatcggggatctgcagtactggatggacgagaactatctctatacctgctttgctcacaccggcgaggttacatcggttaaagtaattcgaaacaagcaaactagtcaatctgaaggttatgggtttattgagtttaatagtcgtgctggagctgagagaattcttcaaacatataatggggcaataatgccaaatggggggcagagtttcaggttgaattgggcaacttttagtgctggtgagaggtcgcgccacgacgattctccagattacaccatatttgttggtgacttggctgcagatgttactgattatcttcttcaggagacatttagggctcgttataactcggtgaagggtgcaaaagttgtcattgataggctaactggccggaccaagggatatggctttgtaaggttttcagatgagagtgagcaagtgagggctatgactgagatgcaaggggttctttgctcaacaagacccatgaggattggacccgcctctaataaaacccccaccactcagtcccagcccaaagcttcatatcagaattctcaacctcaaggttcacagaatgagaatgatccaaataatacaactatttttgttggtaatttggatcctaatgtcactgatgatcatctgaggcaagttttcagccagtatggagaattagtgcatgtgaagattccagcaggcaagcgatgtgggtttgtccaattcgcagacaggagctgtgccgaagaggcacttcgggtgttgaatgggaccctgttgggtggtcaaaatgttcgtctttcatggggccgcagtccttcaaacaaacaggctcaggcagatccaaaccagtggaatggtggtgctggttctggtggtggatactatgggtatgctgcacaaggttatgaaaattatgggtatgctcctgctgctggacaggatcccaacatgtatggcagttatccggggtatcctggttaccaaccacctcagcaacagcaacaaataggatatagt

SEQ ID NO: 62 - protein, 409 aa, Glycine max
  Glyma13g27570.1 (RRM1 67-147, RRM2 159-238, RRM3 269-341)
MMQQPGPGMAPPTMGQQPPQQYQQPPPQQQQPYVMMPPQAQAPQAMWAPSAQPPPQQQPASADEVRTLWIGDLQYWMDENYLYTCFAHTGEVTSVKVIRNKQTSQSEGYGFIEFNSRAGAERILQTYNGAIMPNGGQSFRLNWATFSAGERSRHDDSPDYTIFVGDLAADVTDYLLQETFRARYNSVKGAKVVIDRLTGRTKGYGFVRFSDESEQVRAMTEMQGVLCSTRPMRIGPASNKTPTTQSQPKASYQNSQPQGSQNENDPNNTTIFVGNLDPNVTDDHLRQVFSQYGELVHVKIPAGKRCGFVQFADRSCAEEALRVLNGTLLGGQNVRLSWGRSPSNKQAQADPNQWNGGAGSGGGYYGYAAQGYENYGYAPAAGQDPNMYGSYPGYPGYQPPQQQQQIGYS

SEQ ID NO: 63 - DNA, 1233 bp, Glycine max
  Glyma15g11380.1
atgatgcagcagccaggacccggcatggcacctcccaccatgggccagcagccgcagcaacagtaccagcagcagcctccgccgcagcagcaacaaccctacgtcatgatgccgccgcagcatcaggcgccgcagcctatgtgggccccatccgcccagcctccgctgccgcagcagcctgctagcgccgacgaggtccgaaccctctggatcggggatctgcagtactggatggacgagaactatctctacacctgctttgctcataccggcgaggtttcgtcagttaaagtgattcggaacaagcaaactagtcaatctgaaggttatgggtttattgagtttaatagtcgtgctggagctgagagaattctccaaacatataatggggctattatgccgaatggggggcagagtttcaggttgaattgggcaacttttagtgccggtgagaggtcgcgtcaagatgattctcctgattacaccatatttgttggtgacttggctgcagatgttactgattatcttcttcaggagacattcagggctcgttacaactcggtgaagggtgcaaaagttgtcattgataggctaactggccgtaccaaggggtatggctttgtaaggttttcagaagagagtgagcaaatgagagctatgactgagatgcaaggggttctttgctcaacaagacccatgaggattggaccagcctctaataaaacccctgccactcagtcccagccaaaagcttcatatctgaattctcaacctcaaggctcacagaatgagaatgatccaaataatacgactatttttgttggcaatttggatcctaatgtaaccgatgatcatctgaggcaagttttcagccagtatggagaattagttcatgtgaagattccagcaggcaagcgatgtgggtttgtccaatttgcagacaggagctgtgctgaagaggcccttcgggtgttgaatgggacgctgttgggtggacaaaatgtgcgtctttcatggggtcgcagtccttcaaacaaacaggctcaggcagatccaaaccagtggaatggtgctgctggtgctggttctggtggtggatattatgggtatgctgctcaaggatatgaaaattatggttatgctcctgctggacaggatcccaacatgtatggcagttatccgggatatcctggttaccaagctcctcaacaacagcagcaaataggatatagt

SEQ ID NO: 64 - protein, 411 aa, Glycine max
  Glyma15g11380.1 (RRM1 68-148, RRM2 160-239, RRM3 270-342)
MMQQPGPGMAPPTMGQQPQQQYQQQPPPQQQQPYVMMPPQHQAPQPMWAPSAQPPLPQQPASADEVRTLWIGDLQYWMDENYLYTCFAHTGEVSSVKVIRNKQTSQSEGYGFIEFNSRAGAERILQTYNGAIMPNGGQSFRLNWATFSAGERSRQDDSPDYTIFVGDLAADVTDYLLQETFRARYNSVKGAKVVIDRLTGRTKGYGFVRFSEESEQMRAMTEMQGVLCSTRPMRIGPASNKTPATQSQPKASYLNSQPQGSQNENDPNNTTIFVGNLDPNVTDDHLRQVFSQYGELVHVKIPAGKRCGFVQFADRSCAEEALRVLNGTLLGGQNVRLSWGRSPSNKQAQADPNQWNGAAGAGSGGGYYGYAAQGYENYGYAPAGQDPNMYGSYPGYPGYQAPQQQQQIGYS

SEQ ID NO: 65 - DNA, 1239 bp, Solanum lycopersicum
  Solyc02g080420.2.1
atgcaaccagcgaattccatggttccaccaccacagtaccagcagacacagcagtggatggctcagccgccgccgcagtatcaggttgcgcctccgcagcaatcgggatattactaccagcaacctcagcaacagggcggagttcctccaccccaacaacaacaacttcagtacaacgcctctggtttggctgctactgccggttctgttcagccgactagtgctgatgagatccgaagcctttggatcggagatctacagttttggatggatgagcaataccttctcaactgtttcgcacaaactggagaggtgacctctgctaaagttatccgtaacaagcaaagtggacaatcagagggttatggctttattgagtttattagtcatgctgctgcagaaaggaatctgcaagcatataatggtaccttgatgcctaatattgagcaaaatttcagactcaactgggcttcactcggttctggtgaaaaacgttctgataatggtcctgaatatacaatatttgttggtgacttggcagccgatgtttctgattatatgcttcaggagacatttagggctaactatccttctgtgaagggcgctaaggttgtaacagataaggccacggggcgcaccaagggttatggttttgttaagtttggggatgaaagtgagcagttgcgcgctatgactgagatgaatggacagttttgctccactaggcccatgcggattggtcccgcagctaacaagaagagtatgggtggtcaaagtcaagcttcgtatcaaagttcacctggaactcaaaatgaggacgacccatctaataccactatttttgttgggaacttggattccaatataacggatgaacatttaaggcagatttttggacactatgggcagttgcttcatgtaaaaataccagtaggcaagcggtgtggctttattcagtttgctgacagaagttgtgctgaggaagctctacgggtattaaatggaactcagctgggtggacaaagcatccgtctttcatggggtcgaagtcctgcaaacaagcagcagcctcagcttgatccaaaccaatatgctggttattatgggtatactgctggatatgaaggttatggttatgccccccctgctcaggatccaaatcagtattatgcgggctatgctggatatggaaattacgcacaacctcaacagcagcagcaagttttgcagcatcctcag

SEQ ID NO: 66 - protein, 413 aa, Solanum lycopersicum
  Solyc02g080420.2.1 (RRM1 80-160, RRM2 171-250, RRM3 278-350)
MQPANSMVPPPQYQQTQQWMAQPPPQYQVAPPQQSGYYYQQPQQQGGVPPPQQQQLQYNASGLAATAGSVQPTSADEIRSLWIGDLQFWMDEQYLLNCFAQTGEVTSAKVIRNKQSGQSEGYGFIEFISHAAAERNLQAYNGTLMPNIEQNFRLNWASLGSGEKRSDNGPEYTIFVGDLAADVSDYMLQETFRANYPSVKGAKVVTDKATGRTKGYGFVKFGDESEQLRAMTEMNGQFCSTRPMRIGPAANKKSMGGQSQASYQSSPGTQNEDDPSNTTIFVGNLDSNITDEHLRQIFGHYGQLLHVKIPVGKRCGFIQFADRSCAEEALRVLNGTQLGGQSIRLSWGRSPANKQQPQLDPNQYAGYYGYTAGYEGYGYAPPAQDPNQYYAGYAGYGNYAQPQQQQQVLQHPQ

SEQ ID NO: 67 - DNA, 1233 bp, Solanum lycopersicum
  Solyc10g005260.2.1
atgcaaccggcggcaagttcaatggttccaccaccaatggcggcgcaaccacagtaccaacagcagtggatggctcagcagccgcagtaccaggttctgccaccgcaggccggttattattaccaaccaccaccgcagcagggtggcggagtacccccaccgcagcagcaacaacaacaatctcagtacacggcttcagctcagccgaccagtgctgatgaagtccggacgctttggattggagatctacagttttggatggatgagcagtacctatatagttgcttcgcgcaaactggagaggtggtttccgctaaagttatccgcaacaagcaaactcagcaatcagagggttatggctttattgagtttaatagtcatgctgctgcagaaaggaatctacaagcatacaatggcaccttgatgcctaatattgagcaaaattttaggctcaactgggcatcacttggttcgggtgaaaagcgttcagataacacccctgaatatacaatatttgttggagacttggcagctgatgtcacagattacatgcttcaggagacattcagacccaattatccttcaatcaagggtgctaaggttgtaacagatagggcaaccgggcacacaaagggttatgggtttgttagatttggggatgagagtgagcagttacgagctatgactgagatgaatggaaagttttgctccactaggcccatgcgcattggtcctgcagctaacaagaagaattctggtggtcagatgcaagcttcatatcaaagtactggaactcaaaatgaggatgaccctactaatacgacgattttcgttgggaacttggatgctagtgtaactgatgatcacctcaggcaggtttttgggaactatgggcaattgcttcatgtaaaaataccactaggcaaacgttgtggttttgttcaatttactgatagaagctgtgctgaggaagctctaaatgcattgagtggaactcagttgggtggacaaaccatccgcctttcatggggtcgtagcccttcaaacaagcagcagtctcagggtgatccgaaccagtggagtgggggttattatgggtatacaccaggatatgacgcctatggttatgcccaacctactcaggacccaaatatgtactatgcaggctatgccgggtatgggaattatgcacaacctccacatcaacagcaacaaatgccgcagcagcctcag

SEQ ID NO: 68 - protein, 411 aa, Solanum lycopersicum
  Solyc10g005260.2.1 (RRM1 77-157, RRM2 168-247, RRM3 274-346)
MQPAASSMVPPPMAAQPQYQQQWMAQQPQYQVLPPQAGYYYQPPPQQGGGVPPPQQQQQQSQYTASAQPTSADEVRTLWIGDLQFWMDEQYLYSCFAQTGEVVSAKVIRNKQTQQSEGYGFIEFNSHAAAERNLQAYNGTLMPNIEQNFRLNWASLGSGEKRSDNTPEYTIFVGDLAADVTDYMLQETFRPNYPSIKGAKVVTDRATGHTKGYGFVRFGDESEQLRAMTEMNGKFCSTRPMRIGPAANKKNSGGQMQASYQSTGTQNEDDPTNTTIFVGNLDASVTDDHLRQVFGNYGQLLHVKIPLGKRCGFVQFTDRSCAEEALNALSGTQLGGQTIRLSWGRSPSNKQQSQGDPNQWSGGYYGYTPGYDAYGYAQPTQDPNMYYAGYAGYGNYAQPPHQQQQMPQQPQ

SEQ ID NO: 69 - DNA, 1215 bp, Solanum lycopersicum
  Solyc03g031720.2.1
atgcaaccagcgaattccatggttccacaaccaatggcggctccatcgcaacaacagtatcaacagcagccgcagcaacattggatggctcagcagcagccggcagcgtatcaggttccgcagcagcaatcggcgtattattaccagcaacagcaacaacctcagtacaacgccgcggcagctgctgctcaaccgaccagttccgatgagatccggagcttgtggatcggagatctacagttttggatggatgaacagtatatccagaactgcttcgctcacactggagaggtggcctctgttaaagttatccgcaacaagcaatctggacaatctgagggttatggatttgttgagtttattagtcatgcggctgctgaaagaaacctacaaacatataatggctccatgatgcctaatagtgagcaaccctttagactcaactgggcatcactcggttcgggtgaaaaacgttcagataatggtcctgaatacacaatttttgttggagacttggcagctgatgtcactgactatatgcttcaggagacattcagggccaactacccctcagtcaagggtgcaaaggttgtgactgatagggtcactgggcgcacaaagggctatgggtttgttaaatttgcagatgaaagtgagcaattgcatgctatgactgagatgaatggcaagttctgctccactaggccaatgcggataggccctgcagctaacaagaagagtgtacctggtcaggtgcaagcttcatatcaaagtaccaatggaactcaaaatgaggacgatccttctaatacaactatattcgttgggaatttggatgctaatgtaacagatgaccatctaaggcaggtttttggaaattatggacagttgcttcatgtgaaaataccagtaggcaaacgttgtggctttgttcaatttgctgacagaagttgtgctgaggaagctctacgagcattaagtggaactcagctgggtggacaaactatccgcctttcatggggtcgtagcccttccaacaagcagcagcctcaggctgacccaaaccaatacggtggttattatgggtattcagctggatatgatgctgccgctgctgctgcctatggttatgctcaacctgctcaggatccaaatctatattatgggggttacgctgggtatggaaattaccctccacagcagcaacaaccacag

SEQ ID NO: 70 - protein, 405 aa, Solanum lycopersicum
  Solyc03g031720.2.1 (RRM1 73-153, RRM2 164-243, RRM3 271-343)
MQPANSMVPQPMAAPSQQQYQQQPQQHWMAQQQPAAYQVPQQQSAYYYQQQQQPQYNAAAAAAQPTSSDEIRSLWIGDLQFWMDEQYIQNCFAHTGEVASVKVIRNKQSGQSEGYGFVEFISHAAAERNLQTYNGSMMPNSEQPFRLNWASLGSGEKRSDNGPEYTIFVGDLAADVTDYMLQETFRANYPSVKGAKVVTDRVTGRTKGYGFVKFADESEQLHAMTEMNGKFCSTRPMRIGPAANKKSVPGQVQASYQSTNGTQNEDDPSNTTIFVGNLDANVTDDHLRQVFGNYGQLLHVKIPVGKRCGFVQFADRSCAEEALRALSGTQLGGQTIRLSWGRSPSNKQQPQADPNQYGGYYGYSAGYDAAAAAAYGYAQPAQDPNLYYGGYAGYGNYPPQQQQPQ

SEQ ID NO: 71 - DNA, 957 bp, Brachypodium distachyon
  Bradi2g59240.1
atggaccccaagtttcctcctcccccaccgctaaacaaaacggagcccaccaccggcgtgacgaccaccaccaccacgacctcccagcagcagctggatcacgagcagtatcaccagccgcagcagcacctgcaaatccaagtgcaccagcagcagcaggaggaagatggcggcgggggaaaggagcagcagcagcaggtggtggcggcggcgggggcgggggagaggagggtgcaggggctggggccgaagcggagctccaacaaggaccggcacaccaaggtggacgggcgggggcggcggatccggatgccggcgctgtgcgcggcgcggatcttccagctgacgcgggagctggggcacaagtcggacggggagacggtccagtggctgctgcagcaggcggagccggccatcgtcgccgccacagggtccggcaccataccggcgtccgcgctcgcctccgtcgcgccctcgctgccttcgcccacctccgcgctcgccaggccgcaccaccaccaccacctctgggggccctcggcggcggggttctccccggccgggttcatgaactcggccccagccggcgctgactctgggggcggcctcggcgggcttatgcagaggatagggcttcccgccgggatggagctccctggcggcggtggtggggggcacatcgggttcgcgcccatgttcgccagccacgcggcggcggcggcggccatgccggggctggagctcgggctgtcccaggaaggccacatcggcgtgctcgccgcgcagtccttcagccagttctaccaccaggtcggcggcgccgggggcagcggccagctgcagcacccgcaccctcagcagcatcaccatcaccaacagccgcagcagcagcagcagcaagaggacggggaggacgaacgcgacgagggcgactccgacgaggagtccggcgggcag

SEQ ID NO: 72 - protein, 319 aa, Brachypodium distachyon
  Bradi2g59240.1 (TCP domain 84-145)
MDPKFPPPPPLNKTEPTTGVTTTTTTTSQQQLDHEQYHQPQQHLQIQVHQQQQEEDGGGGKEQQQQVVAAAGAGERRVQGLGPKRSSNKDRHTKVDGRGRRIRMPALCAARIFQLTRELGHKSDGETVQWLLQQAEPAIVAATGSGTIPASALASVAPSLPSPTSALARPHHHHHLWGPSAAGFSPAGFMNSAPAGADSGGGLGGLMQRIGLPAGMELPGGGGGGHIGFAPMFASHAAAAAAMPGLELGLSQEGHIGVLAAQSFSQFYHQVGGAGGSGQLQHPHPQQHHHHQQPQQQQQQEDGEDERDEGDSDEESGGQ

SEQ ID NO: 73 - DNA, 843 bp, Oryza sativa
  LOC_Os01g69980.1
atggaccccaaattccccccacccccaccgctaaacaaaacggagcccaccaccaccaccaccaaccagcagcatcaccacgatgagcagcagcagcagcatcgcctccagattcaagttcatcctcagcagcaggagcagcaggatggaggtggaggaggagggaaggatcagcagcagcagcagcagatgcaggtggtggttgcggcggcggcgggggagaggaggatgcaggggctagggccgaagcggagctcgaacaaggaccgccacaccaaggtggacgggcgggggcggcggatccggatgccggcgctgtgcgccgcccggatcttccagctcacgcgggagctcggccacaagtccgacggcgagaccgtccagtggctgctccagcaggcggagccggccatcgtcgccgccacggggaccgggaccatcccggcgtccgcgctcgcctccgtcgccccctccctcccttcccccaactccgccctctccaggtcgcaccaccaccaccaccacatgtgggcggcagcgccgcccacggcgtccgccgggttcgccggtgcagggttctccggcgccgactccggggtgatcggcgggatcatgcagcggatggggatccccgccgggatcgagctccagggcgggggagcgggggggttggggggtgggggtggcggcggcggtggccacatcgggttcgcgcccatgttcgccagccacgcggcggcggcggcggccatgccggggctagagctagggctctcgcaggacggccacatcggcgtgctcgccgcgcagtcgctcagccagttctaccaccaggtcgttgtg

SEQ ID NO: 74 - protein, 281 aa, Oryza sativa
  LOC_Os01g69980.1 (TCP domain 83-144)
MDPKFPPPPPLNKTEPTTTTTNQQHHHDEQQQQHRLQIQVHPQQQEQQDGGGGGGKDQQQQQQMQVVVAAAAGERRMQGLGPKRSSNKDRHTKVDGRGRRIRMPALCAARIFQLTRELGHKSDGETVQWLLQQAEPAIVAATGTGTIPASALASVAPSLPSPNSALSRSHHHHHHMWAAAPPTASAGFAGAGFSGADSGVIGGIMQRMGIPAGIELQGGGAGGLGGGGGGGGGHIGFAPMFASHAAAAAAMPGLELGLSQDGHIGVLAAQSLSQFYHQVVV

SEQ ID NO: 75 - DNA, 945 bp, Zea mays
  GRMZM2G034638_T01
atggaccccaagttccccccacccccaccgctaaacaaaacggagcccaccaccgcgacgaccaccaccacctcgaccgcgcagcagcagcagcagcagctggatcctaaggactaccagcagcagcagcagcagccggcgcagcacctgcaaatccaaatccaccagtcgcagcaggacggaggcggcggagggaaggagcagcagcagctgcaggtggtggcgcagcccggggagaggaggcagcaggcgctcgcgcccaagcggagctccaacaaggaccgacacaccaaggtcgacggcaggggccggcggatccggatgcccgcgctctgcgccgcgcggatcttccagctcacgcgggaactcggccacaagtccgacggcgagaccgtccagtggctgctgcagcaggccgagccggccatcgtcgccgccaccggcacgggcaccataccggcgtccgcgctcgcctccgtcgcgccctcgctcccgtcgcccacctccgggctcgccaggccgcaccaccacatgtgggcgccgtccgccggcttctcctcgccctccttcctgaactctgccgccgcgggcacgggcgatgccgccggtatcatgcagcggatggggatccccgcgggcttcgagctgccgggagcctccgccgccggagccaccctcggcgccggcggccacatcggctttgcgcccatgttcgctggacacgccgccgccatgccggggctcgagctcgggctatcgcaggacggccacatcggcgtgctcgccgcgcagtcgatcagccagttctaccaccaggtgggtgctgccgccggcggcggcggccagatgcatcacgcgcacgggcaccatcatcaccatcaccagcagcaggaggacggggaggacgaccgcgaggacggcgagtccgatgacgagtctgggcag

SEQ ID NO: 76 - protein, 315 aa, Zea mays
  GRMZM2G034638_T011 (TCP domain 88-149)
MDPKFPPPPPLNKTEPTTATTTTTSTAQQQQQQLDPKDYQQQQQQPAQHLQIQIHQSQQDGGGGGKEQQQLQVVAQPGERRQQALAPKRSSNKDRHTKVDGRGRRIRMPALCAARIFQLTRELGHKSDGETVQWLLQQAEPAIVAATGTGTIPASALASVAPSLPSPTSGLARPHHHMWAPSAGFSSPSFLNSAAAGTGDAAGIMQRMGIPAGFELPGASAAGATLGAGGHIGFAPMFAGHAAAMPGLELGLSQDGHIGVLAAQSISQFYHQVGAAAGGGGQMHHAHGHHHHHHQQQEDGEDDREDGESDDESGQ

SEQ ID NO: 77 - DNA, 972 bp, Zea mays
  GRMZM2G092214_T01
atggaccccaagttccccacacccctagcgctaaacaaaacggagcccaccaccgcgacgaccaccaccacctcgaccgcgcagcatcatcagctggatcctaaggactaccagcagcagacggcgcagcaccaggagcagcagcagcaccaccatcacccccacctgcaaatccaaatccaccagccgccgccgccgccgcaggacgggggcggcggagtgaaggagcagcagcagctgctgcaggtggtggcgcagcccggggatcggaggcagcaggcgctcgcccccaagcggagctccaacaaggaccgccacaccaaggtcgacggcaggggccgccggatccggatgccggcgctctgcgccgcgcggatcttccagctcacgcgggagctcggccacaagtccgacggcgagactgtgcagtggctgctgcagcaggccgagccggccatcgtcgccgccaccggcacgggcaccataccggcgtccgcgctcgcctccgtcgcgccctcgctcccgtcgcctacctccgggctcgccaggccgcaccaccaccacccgcaccacatgtgggcgccgtccgccggcttctcctcgccctccttcctgaattccgcgggcgcgggcgacggcaccggtatcggcggcatcatgcagcggatgggggtccccgcgggcctggagctgccgggaggcggcgccgccggcggccacatcggctttgcgcccatgttcgctggacacgccgcggccatgccggggctcgagctcggcctctcgcaggacggtcacatcggcgtgctcgccgcgcagtcgatcagccagttctaccaccaggtgggtgccgctgccggcggcagtggccagatgcagcacccgcacgggcaccagcatcaccatcatcagcagcaggaggacggggaggacgaccgcgaggacggcgagtctgatgacgagtctgggcag

SEQ ID NO: 78 - protein, 324 aa, Zea mays
  GRMZM2G092214_T011 (TCP domain 98-159)
MDPKFPTPLALNKTEPTTATTTTTSTAQHHQLDPKDYQQQTAQHQEQQQHHHHPHLQIQIHQPPPPPQDGGGGVKEQQQLLQVVAQPGDRRQQALAPKRSSNKDRHTKVDGRGRRIRMPALCAARIFQLTRELGHKSDGETVQWLLQQAEPAIVAATGTGTIPASALASVAPSLPSPTSGLARPHHHHPHHMWAPSAGFSSPSFLNSAGAGDGTGIGGIMQRMGVPAGLELPGGGAAGGHIGFAPMFAGHAAAMPGLELGLSQDGHIGVLAAQSISQFYHQVGAAAGGSGQMQHPHGHQHHHHQQQEDGEDDREDGESDDESGQ

SEQ ID NO: 79 - DNA, 972 bp, Zea mays; identical to SEQ ID NO: 77
  GRMZM2G092214_T02

SEQ ID NO: 80 - protein, 324 aa, Zea mays; identical to SEQ ID NO: 78
  GRMZM2G092214_T021 (TCP domain 98-159)

SEQ ID NO: 81 - DNA, 858 bp, Eucalyptus grandis
  Eucgr.B03529.1
atggagtcgaatggctcaaatcagcagcaacaccaaaaagaaaagaacccttctgagatcaaggacttccagattgtgattgcgagcaaggacgagtcgaagaagcaattggcgcccaagagaagctccaacaaggacaggcacaagaaggtggatggcagaggaaggagaatcaggatgcctgctctgtgtgcagctaggattttccaattgaccagagaattgggtcacaagaccgatggagagacgatccagtggctgttgcagcaagccgagccgtcgatcgttgccgccaccgggaccgggacggtccccgcctcggccctcaacgcggcaggctcctctgtttcggaacagggcagctctgtttcggccaagatggaagggttggcgggtgtggggccgcttcttgggtttggaggcaggaccaatttggcgatttcgaatgggaatttcagtagatcgcaggttgtcagcggggtttggcccccagtgagcggtatcaggccggggctcgttcattaccccgatcagtctgcagctgtgggggcgaacatagggggtgagagctcgaattacgtgtccaagtttgggtttcaaggggtcgagtttccgaacatgaatgtggggctgatcagcttccccactttcttgagtgggtcaaaccagaggatgcccggtttggagctggggctatcgcaggatggtcatggtggggtcttgaattctcactcatcattgagccagattttccagcagatggggcagagcggagggggcgagacggtctcggtgggtcatcaccagcagcaacaaaccccagatgatgaaggggacggttcgcaagagtcagaggag

SEQ ID NO: 82 - protein, 286 aa, Eucalyptus grandis
  Eucgr.B03529.1 (TCP domain 40-101)
MESNGSNQQQHQKEKNPSEIKDFQIVIASKDESKKQLAPKRSSNKDRHKKVDGRGRRIRMPALCAARIFQLTRELGHKTDGETIQWLLQQAEPSIVAATGTGTVPASALNAAGSSVSEQGSSVSAKMEGLAGVGPLLGFGGRTNLAISNGNFSRSQVVSGVWPPVSGIRPGLVHYPDQSAAVGANIGGESSNYVSKFGFQGVEFPNMNVGLISFPTFLSGSNQRMPGLELGLSQDGHGGVLNSHSSLSQIFQQMGQSGGGETVSVGHHQQQQTPDDEGDGSQESEE

SEQ ID NO: 83 - DNA, 942 bp, Arabidopsis thaliana
  AT3G27010.1
atggatcccaagaacctaaatcgtcaccaagtaccaaatttcttgaacccaccaccaccaccgcgaaatcagggtttggtagatgatgatgctgcttctgctgttgtttccgacgagaatcgcaaaccaacaactgagattaaagatttccagatcgtggtctctgcttccgacaaagaaccaaacaagaagagtcagaatcagaaccagcttggtcctaagagaagctctaacaaagacagacacactaaagtcgaaggtagaggtcgacgaattcggatgcctgctctttgtgctgctaggatttttcaattgactagagaattgggtcataaatctgatggtgaaactatccagtggctgcttcaacaagctgagccatcgattattgcagctactggttcaggaactataccggcctctgctttagcttcttcagctgcaacctctaaccatcatcaaggtgggtctcttactgctggtttaatgatcagtcatgacttagatggtgggtctagtagtagtggtagaccattaaattgggggattggtggcggtgaaggagtttctaggtcaagtttaccaactgggttatggccaaatgtagctgggtttggttctggtgtgccaaccactggtttaatgagtgaaggagctggttatagaattgggtttcctggttttgattttcctggtgttggtcatatgagttttgcatctattttgggtgggaatcataatcagatgcctggacttgagttaggcttgtctcaagaagggaatgttggtgttttgaatcctcagtcttttactcagatttatcaacagatgggtcaggctcaggctcaagctcaaggtagggttcttcaccatatgcatcataaccatgaagaacatcagcaagagagtggtgagaaagatgattctcaaggctcaggtcgt

SEQ ID NO: 84 - protein, 314 aa, Arabidopsis thaliana
  AT3G27010.1 (TCP domain 74-135)
MDPKNLNRHQVPNFLNPPPPPRNQGLVDDDAASAVVSDENRKPTTEIKDFQIVVSASDKEPNKKSQNQNQLGPKRSSNKDRHTKVEGRGRRIRMPALCAARIFQLTRELGHKSDGETIQWLLQQAEPSIIAATGSGTIPASALASSAATSNHHQGGSLTAGLMISHDLDGGSSSSGRPLNWGIGGGEGVSRSSLPTGLWPNVAGFGSGVPTTGLMSEGAGYRIGFPGFDFPGVGHMSFASILGGNHNQMPGLELGLSQEGNVGVLNPQSFTQIYQQMGQAQAQAQGRVLHHMHHNHEEHQQESGEKDDSQGSGR

SEQ ID NO: 85 - DNA, 729 bp, Arabidopsis thaliana
  AT5G41030.1
atggtcatggagcccaagaagaaccaaaatctaccaagtttcttaaacccatcacgacagaatcaggacaacgacaagaagaggaaacaaacagaggttaaaggtttcgacattgtggtcggcgaaaagaggaagaagaaggagaatgaagaggaagaccaagaaattcagattctttatgagaaggagaagaagaaaccaaacaaagatcgtcaccttaaagttgaaggaagaggtcgtagagttaggttacctccactctgtgcagcaaggatttatcaattgactaaagaattaggtcacaaatcagatggtgagactcttgaatggttgcttcaacatgctgagccatcgatactctctgctactgtaaatggtatcaaacccactgagtctgttgtttctcaacctcctctcacggctgatttgatgatttgtcatagcgttgaagaagcttcaaggactcaaatggaggcaaatgggttgtggagaaatgaaacaggacagaccattggagggtttgatctgaattacggaattgggtttgatttcaatggtgttccagagattggttttggagataatcaaacgcctggacttgaattaaggctgtctcaagttggggttttgaatccacaggtttttcaacaaatgggtaaagaacagttcagggttcttcatcatcattcacatgaagatcagcagcagagtgcagaggaaaatggttca

SEQ ID NO: 86 - protein, 243 aa, Arabidopsis thaliana
  AT5G41030.1 (TCP6, G1936, TCP domain 64-125)
MVMEPKKNQNLPSFLNPSRQNQDNDKKRKQTEVKGFDIVVGEKRKKKENEEEDQEIQILYEKEKKKPNKDRHLKVEGRGRRVRLPPLCAARIYQLTKELGHKSDGETLEWLLQHAEPSILSATVNGIKPTESVVSQPPLTADLMICHSVEEASRTQMEANGLWRNETGQTIGGFDLNYGIGFDFNGVPEIGFGDNQTPGLELRLSQVGVLNPQVFQQMGKEQFRVLHHHSHEDQQQSAEENGS

SEQ ID NO: 87 - DNA, 951 bp, Citrus clementina
  clementine0.9_016144m
atggatcccaaggcctcaaagcaaccctcacaacaagaagtagccaacttcttgaacataccacaacaacaacagcagcaacagccacagcagctacaacaagtgaatatgggcgagaacaagccagcggagatcaaagattttcagattgtgatagctgataaagaggaacaaaccaagaaacagttggcacccaaaagaagctcaaacaaagataggcacacaaaagttgaaggcagagggaggagaattaggatgcctgctttatgcgccgcaagaatctttcagttaacaagggaattgggtcacaaatctgatggtgaaacaattcaatggttgctgcaacaagccgagccatctataattgcagccactgggactgggacaataccagcatcagctttggcagctgctggtggctctgtttctcaacaaggtgcctctttgactgctggtttgcatcaaaagattgatgatttagggtccagtaggaccagctgggggggtttagttggtggcaatttagtaggaaggtctcatcaaatgccagcagcagggttatggccccaacctgtaagtgggtttgggtttcagtcatcatcatcttctggtccatcaacagggaatttagggaccgaaaattctaattatttgcaaaagatggggttccctgggtttgacctgccaggtacaggaactgctactactaacatgggtcctatgagttttacttctattttgggtagtgctagtaatcagcagttacctggtttggagcttgggttgtcgcaagatggtcatattggggttttgaatccacaaactttgactcaaatttatcagcagatgggtcatgctagggtgcatcagcaacagcagcagcagcaacatccgcaacagcagcagcaagcagctcctgttaataaggatgattcacaagggtcagggcag

SEQ ID NO: 88 - protein, 317 aa, Citrus clementina
  clementine0.9_016144m (TCP domain 66-127)
MDPKASKQPSQQEVANFLNIPQQQQQQQPQQLQQVNMGENKPAEIKDFQIVIADKEEQTKKQLAPKRSSNKDRHTKVEGRGRRIRMPALCAARIFQLTRELGHKSDGETIQWLLQQAEPSIIAATGTGTIPASALAAAGGSVSQQGASLTAGLHQKIDDLGSSRTSWGGLVGGNLVGRSHQMPAAGLWPQPVSGFGFQSSSSSGPSTGNLGTENSNYLQKMGFPGFDLPGTGTATTNMGPMSFTSILGSASNQQLPGLELGLSQDGHIGVLNPQTLTQIYQQMGHARVHQQQQQQQHPQQQQQAAPVNKDDSQGSGQ

SEQ ID NO: 89 - DNA, 951 bp, Citrus clementina; identical to SEQ ID NO: 87
  clementine0.9_016174m

SEQ ID NO: 90 - protein, 317 aa, Citrus clementina; identical to SEQ ID NO: 88
  clementine0.9_016174m (TCP domain 66-127)

SEQ ID NO: 91 - DNA, 960 bp, Populus trichocarpa
  POPTR_0001s33470.1
atggatcccaagggctctaactcaaaaaacccacatgagttacccactttcttgacccacacccacccttctcctcctcatcctcctccacaacctcatcttcaacaaccacaacaactccatagccaaaaccaacaacaacccaacatgggagacaacaaaccagcagaaatcaaagactttcagattgtagtagctgacaaagaagagcaaaagaaacagttagcaccaaagagaagctcaaacaaagacagacacacaaaagttgaaggtagaggtagaaggataaggatgccagctctttgtgcagcgagaatctttcaattgacaagagaattgggtcacaaatctgatggagagacaatacagtggcttctacaacaagctgaaccatctataattgcagcaactgggactggtactatacctgcatcagctttagcagctgctggcggtgcaatttcacaacaaggagcttctctttctgctggtttgcatcaaaagattgatgatttaggtgggtccagtagtagtagggccagttgggcaatgttaggtggcaatttagggagaccccatcatgttactactgcaggattatggcccccagttggaggttatgggttccagtcatcatctaattccactggtccatcaacaacaaatatagggactgaagctgctgctgctggtggttctagttatttgcaaaaactcgggtttccagggtttgacttgccgggtaacaacatggggcctatgagttttacttcaattttaggtgggggtacccagcagttaccaggattggaacttgggttgtcacaggacgggcatattggggttttgagtccacaagctttgaatcagatttatcagcagatggggcatgctagagtgcaccagcagcagcatcagcaacaaaatccttctaaagatgattcacaaggatcaggccag

SEQ ID NO: 92 - protein, 320 aa, Populus trichocarpa
  POPTR_0001s33470.1 (TCP domain 78-139)
MDPKGSNSKNPHELPTFLTHTHPSPPHPPPQPHLQQPQQLHSQNQQQPNMGDNKPAEIKDFQIVVADKEEQKKQLAPKRSSNKDRHTKVEGRGRRIRMPALCAARIFQLTRELGHKSDGETIQWLLQQAEPSIIAATGTGTIPASALAAAGGAISQQGASLSAGLHQKIDDLGGSSSSRASWAMLGGNLGRPHHVTTAGLWPPVGGYGFQSSSNSTGPSTTNIGTEAAAAGGSSYLQKLGFPGFDLPGNNMGPMSFTSILGGGTQQLPGLELGLSQDGHIGVLSPQALNQIYQQMGHARVHQQQHQQQNPSKDDSQGSGQ

SEQ ID NO: 93 - DNA, 963 bp, Populus trichocarpa
  POPTR_0017s09820.1
atggatcccaagggctctaactcaaaaaacccacatgagctacccactttctttacccttacgcacacccacacttctccttctccttctcctcatactcctccacaaccccatcatcaacaaccgcaacacctccataaccaaaaccaactacaacccaacatgggtgagaataaagcagcagaaatcaaagactttcagattgtagtagctgacaaagaagagcaaaagaaacagttagctccaaaaagaagctcaaacaaagacagacacacaaaagttgaaggtagaggtagaaggataaggatgccagctctttgtgcagcaagaatctttcaattaacaagagaattgggtcacaaatctgatggtgagacaatacagtggcttctacaacaagctgaaccatctataattgcagcaactgggactggtacaatacctgcatcagctttggcagctgctggtggtgcaatttcacaacaaggagcttctctttcagctggtttgcatcaaaagattgatgatataggtgagtccagtagtaggaggaccagttgggcaatgttaggtggcaatttagggagaccccatcaagttacaagtgcaggattatggcccccagttggaggttatgggttccagtcatcatctaataccactggtccatcaacaacaaatatagtaagtgaaggtggtggtggctcgagttatttgcaaaaaaatggattttcagggtttgacatgccaggaaacaatattgggcctatgagtcttacttcaattttaggtgtgggtagccagcagttaccaggattggagcttgggttgtcacaagatgggcatattggggttttgagcccacaagctttgagtcagatttatcagcagatggggcaggctagggtgcagcagcaccagcagcaaaacccttctaaagatgattcacaaggatcagggcag

SEQ ID NO: 94 - protein, 321 aa, Populus trichocarpa
  POPTR_0017s09820.1 (TCP domain 83-144)
MDPKGSNSKNPHELPTFFTLTHTHTSPSPSPHTPPQPHHQQPQHLHNQNQLQPNMGENKAAEIKDFQIVVADKEEQKKQLAPKRSSNKDRHTKVEGRGRRIRMPALCAARIFQLTRELGHKSDGETIQWLLQQAEPSIIAATGTGTIPASALAAAGGAISQQGASLSAGLHQKIDDIGESSSRRTSWAMLGGNLGRPHQVTSAGLWPPVGGYGFQSSSNTTGPSTTNIVSEGGGGSSYLQKNGFSGFDMPGNNIGPMSLTSILGVGSQQLPGLELGLSQDGHIGVLSPQALSQIYQQMGQARVQQHQQQNPSKDDSQGSGQ

SEQ ID NO: 95 - DNA, 1035 bp, Glycine max
  Glyma16g05840.1
atggatcccaagggctcaaagcagcagccacagcaatcacaggaggtggtaccaaacttcctcagcctcccccaacagcaacaagggaataccaacaacaacaacatgggagagaacaaacctgcagaggtgaaggatttccagatagtggtagctgagaacaaggaagagagcaagaaacagcagcaacagttggcaccaaagaggagttccaacaaggacaggcacaccaaggttgaaggcaggggaaggaggataaggatgcctgctctctgcgcagccagaatcttccagttgaccagggaattgggtcacaaatctgatggggaaaccatccagtggctcctccagcaggctgagccatccatcatagctgccactgggactggcacaataccagcatctgctcttgctgctgctggaaactcactctcaccacaagctgcttctctttcatcatccttgcaccaacatcaacaaaagattgatgaattgggtgggtcaggggggagtagtagtagggccagctggcaaatggttggggggaatttggggagaccccatttgggtgtgggtgtggccacagcagcaggcctatggccccctcatgtcagtggatttggatttcaaacaccaccaacaacaacaacaccaacaacaacaacatcatcatctggtccatctaatgccaccttagccactgagagctccaattaccttcagaaaattgcattccctggctttgacttgcctacttctgccactaacatgatgggtcacatgagtttcacctcaattttgggtggaggtgggggtggtggggcccagcatatgcctggcttggagcttggtctttcccaggatggccatattggggtgttgaatcaacaggccttgaaccagatttatcagcagatgaatcaggctggtagagtgcatcatcatcagcatcagcatcatcatcagcatcatcagcagcaacaacaccatcagcaaactcctgctaaggatgattctcaaggctcaggaggacag

SEQ ID NO: 96 - protein, 345 aa, Glycine max
  Glyma16g05840.1 (TCP domain 68-129)
MDPKGSKQQPQQSQEVVPNFLSLPQQQQGNTNNNNMGENKPAEVKDFQIVVAENKEESKKQQQQLAPKRSSNKDRHTKVEGRGRRIRMPALCAARIFQLTRELGHKSDGETIQWLLQQAEPSIIAATGTGTIPASALAAAGNSLSPQAASLSSSLHQHQQKIDELGGSGGSSSRASWQMVGGNLGRPHLGVGVATAAGLWPPHVSGFGFQTPPTTTTPTTTTSSSGPSNATLATESSNYLQKIAFPGFDLPTSATNMMGHMSFTSILGGGGGGGAQHMPGLELGLSQDGHIGVLNQQALNQIYQQMNQAGRVHHHQHQHHHQHHQQQQHHQQTPAKDDSQGSGGQ

SEQ ID NO: 97 - DNA, 990 bp, Glycine max
  Glyma19g26560.1
atggatcccaagggctcaaagcagcagcagccacaggaggtggtaccaaaattcctcagcctcccccaacaccactaccaacaacaagggaattccaacaacaacaacatgggagagaacaaaccatcagaggttaaggatttccagatagtggtagctgctgagaaggacgagagcaagaagcagcaacagttggcaccaaagaggagttccaacaaggacaggcacaccaaggttgagggcagggggaggaggataaggatgcctgctctctgtgctgccagaatcttccagttgaccagagaattgggccacaaatctgatggggaaaccatccagtggctcctccagcaggctgagccatccatcatagctgccactgggactggcacaatcccagcatctgctcttgctgctgctggcaactcactctcacctcaaggttcctctctttcatcagccttacaccaccaacaccaaaagattgatgaattaggttgtgggtcaggtgggagcagtagggccagctggcagatggttggggggaatttggggagaccccatttgggtgtggccacaacaggcctatggcccccccatgtcagtggatttggatttcagacagcaacaacaacaacaacaacaacatcatctggtccatctaatgccaccttagccactgagagctccaattacctccagaaaattgccttccctggctttgacttgcctacttctgccaccaacatgggtcacatgagtttcacctcaattttgggtggtgctggttcccagcagatgcctggtttggagcttggactttcccaggatggccatattggggtgctgaatccacaggccttgaaccagatttatcagcagatgaatcatcaggctcaagctggtagagtgcatcaacagcatcagcatcagcaacaacagcatcagcaaactcctgctaaggatgattctcaaggctcaggaggacag

SEQ ID NO: 98 - protein, 330 aa, Glycine max
  Glyma19g26560.1 (TCP domain 68-129)
MDPKGSKQQQPQEVVPKFLSLPQHHYQQQGNSNNNNMGENKPSEVKDFQIVVAAEKDESKKQQQLAPKRSSNKDRHTKVEGRGRRIRMPALCAARIFQLTRELGHKSDGETIQWLLQQAEPSIIAATGTGTIPASALAAAGNSLSPQGSSLSSALHHQHQKIDELGCGSGGSSRASWQMVGGNLGRPHLGVATTGLWPPHVSGFGFQTATTTTTTTSSGPSNATLATESSNYLQKIAFPGFDLPTSATNMGHMSFTSILGGAGSQQMPGLELGLSQDGHIGVLNPQALNQIYQQMNHQAQAGRVHQQHQHQQQQHQQTPAKDDSQGSGGQ

SEQ ID NO: 99 - DNA, 822 bp, Citrus clementina
  clementine0.9_018374m
atggcagagaataacaagcctggtgagatcaaagatttccaaatcatgattgcaaacaaagatgatagtaccaagaagttggcaccaaaaagaagctctaacaaagatagacacaaaaaagtagatggcagaggaagaagaatcaggatgccagctttatgtgctgccaggatttttcaattgaccagggaattgggtcataaatcggatggagagacaattcaatggctgttacagcaagctgaaccatctatcatcgctgctacaggaactgggactattccagcctctatgcttgctgctgcaggggcctctgtttccgaacaggggaactctgtttcagcaggcttgcatgcaaaaatagaagggttgggaccaggtgttgggtccattaatagggccaactggacaatgatgagtgcaaattttggaaggtctcaaattccaagtggagtttggccaactataaatggaactgggtctgggtttattcaaaattctggccagttgacttcaaattttggaagtgaaaatttgagtgcaaatccaaaatttgggttccacgggattgaatttccaaatatgaatatgggtttgatgagtttctcctctatgttgagcggtgctagccatcaaattcctggcttggagcttggtctctcacaggatgcgcatgtgggggtgatgaattctcaagctataagccagttctatcaacagatggggcatcacagaagcgcttcaggatccttgaatcagcagcatcagcatcagcagcaaatttctgataaggatgattctcagggatcaggatcaaagcag

SEQ ID NO: 100 - protein, 274 aa, Citrus clementina
  clementine0.9_018374m (TCP domain 30-91)
MAENNKPGEIKDFQIMIANKDDSTKKLAPKRSSNKDRHKKVDGRGRRIRMPALCAARIFQLTRELGHKSDGETIQWLLQQAEPSIIAATGTGTIPASMLAAAGASVSEQGNSVSAGLHAKIEGLGPGVGSINRANWTMMSANFGRSQIPSGVWPTINGTGSGFIQNSGQLTSNFGSENLSANPKFGFHGIEFPNMNMGLMSFSSMLSGASHQIPGLELGLSQDAHVGVMNSQAISQFYQQMGHHRSASGSLNQQHQHQQQISDKDDSQGSGSKQ

SEQ ID NO: 101 - DNA, 783 bp, Populus trichocarpa
  POPTR_0001s13500.1
atggaacctaagggcccaaatcatcatcaactacaggtgccctctttcttgaatcctccacaaaaagcaagcatgccagagaacaacatcaacaaccataacaagcagcctgctgagatcaaagatttccaaattatgattgaaaacagagatcataacaagaagcaattagcaccaaagagaagctccaacaaggacaggcacaagaaagtggatggtagaggaaggaggataaggatgccagctctttgtgcggcgaggatttttcaactgacgagagaactggggaataaatctgatggagaaacaattcagtggttgttgcaacaagcagaaccatcgattattgctgcgactggtactgggacttttcctgcttcagctcttgcagttgcaggggcctctgtttcagaacaggggaactctgtttcaacaggattgcatacaaaaatggaagggttgggacccgctgttgttgggtccagagataggactaactggaccatgatgaatactaatttaggaagatctaatgtggcaagtggggtctggccctctgttggcgggattgggtcagggtttgttccaaattctggtcagtcaacatcgaattttggaaatgaaaactccactactttaccaaagattggagcttggactttcacaggatgggcatggtgggatgttcaatcctcaagctttgaatcccttttgccagcagatggtgcagggccgtggtgtcttaaattcgttgaatcaagaacagcagcaagagcaacctca

SEQ ID NO: 102 - protein, 261 aa, Populus trichocarpa
  POPTR_0001s13500.1 (TCP domain 60-121)
MEPKGPNHHQLQVPSFLNPPQKASMPENNINNHNKQPAEIKDFQIMIENRDHNKKQLAPKRSSNKDRHKKVDGRGRRIRMPALCAARIFQLTRELGNKSDGETIQWLLQQAEPSIIAATGTGTFPASALAVAGASVSEQGNSVSTGLHTKMEGLGPAVVGSRDRTNWTMMNTNLGRSNVASGVWPSVGGIGSGFVPNSGQSTSNFGNENSTTLPKIGAWTFTGWAWWDVQSSSFESLLPADGAGPWCLKFVESRTAARATS

SEQ ID NO: 103 - DNA, 906 bp, Populus trichocarpa
  POPTR_0003s16630.1
atggaacctaagagcccaaatcaatatcaaccacagatgccctctttcttgaatcctccacaagaagcaagcatgtcagagaacaacatcaacagcaataacaacaagcctgcagatatcgaagattttcaaaatatgatggcggacaaagatgatagcaagaagaaattagcaccaaagagaagctccaacaaagacaggcacaagaaagtggaaggtagaggaaggaggataaggattccagctctttgcgcggccaggatttttcaattgacaagagaattggagcataaatctgatggagaaacaattcagtggttgttgcaacaggcagaaccatcgattattgctgcgactggtactgggaccattcctgcatcagctcttgcagctgcaggagcctctgtttcagagcaggggggctctgtttcaactggattgcatgcaaaaatggaagggttgggaccaggagttactgggtccagagataggaatgattggaccctgtcgaatactaaattaggaatatctaatgtggcaactggggtctggccatctgttggtggaattgggttaggatttgttcccaattctggtcaatcaacatcgaattttggaaacgaaaactccagtactttaccgaaatatgggttccaaggggttgagtttccaaatattaacatgggcttaatgagtttttactccatgtttagtggcactaaccagcaacttcctggcttggagcttggactttcacaggatggccacagtgcgatgttaaatcctcaagctttgagtcccttttaccatcagatggtgcagggtcgtggtgtcttggattcgttgaatcaagaaaagcagcaagagcaacctcctgataaagatgattcccaaggatcaaggcag

SEQ ID NO: 104 - protein, 302 aa, Populus trichocarpa
  POPTR_0003s16630.1 (TCP domain 60-121)
MEPKSPNQYQPQMPSFLNPPQEASMSENNINSNNNKPADIEDFQNMMADKDDSKKKLAPKRSSNKDRHKKVEGRGRRIRIPALCAARIFQLTRELEHKSDGETIQWLLQQAEPSIIAATGTGTIPASALAAAGASVSEQGGSVSTGLHAKMEGLGPGVTGSRDRNDWTLSNTKLGISNVATGVWPSVGGIGLGFVPNSGQSTSNFGNENSSTLPKYGFQGVEFPNINMGLMSFYSMFSGTNQQLPGLELGLSQDGHSAMLNPQALSPFYHQMVQGRGVLDSLNQEKQQEQPPDKDDSQGSRQ

SEQ ID NO: 105 - DNA, 339 bp, Solanum lycopersicum
  Solyc02g094290.1.1
atgaaacgtcagaataccaataataccatggagatgaaagactttcagattggaattgcagaaaaagatgaagctaagaagcatcaattggctcctaaaagaaaatcgaataaagataggcacactaaagttgaaggcagaggaaggaggattcgcatgcctgcactctgtgctgctaggattttccaactcacgcgcgaattgggtcataaatctgatggagagaccatccagtggctattacagaaagcggaaccctccataattgctgcaactggccatggaacaattcaggcatcgctttaccggcggctggaccctctgtttcgcaacagggaa

SEQ ID NO: 106 - protein, 113 aa, Solanum lycopersicum
  Solyc02g094290.1.1 (TCP domain 33-94)
MKRQNTNNTMEMKDFQIGIAEKDEAKKHQLAPKRKSNKDRHTKVEGRGRRIRMPALCAARIFQLTRELGHKSDGETIQWLLQKAEPSIIAATGHGTIQASLYRRLDPLFRNRE

SEQ ID NO: 107 - DNA, 1248 bp, Arabidopsis thaliana
  AT2G46970.1
atggaagcaaaacccttagcatcatcatcatctgaaccaaacatgatttctccatcatcaaacattaaaccaaaattaaaagatgaagattatatggagctggtgtgtgaaaatgggcagattcttgcaaagattcgaagaccaaagaacaacggttcttttcaaaagcaacgtaggcaatctctcctggatttgtatgagaccgagtacagcgagggtttcaagaaaaacatcaagattcttggagacacacaagttgttccggtgagtcagtctaagccacaacaagataaagaaaccaatgaacaaatgaacaacaataagaagaagctaaagtcctccaaaatcgaatttgagagaaatgtttcgaaaagcaacaaatgtgttgaatcatcaacattaattgatgtttctgctaaaggtccaaagaatgttgaagttactacagctcctcctgatgagcaatctgcagctgttggtagatccacggaattgtattttgcttcttcatcgaagttttctcgaggaacttcgagagatctaagttgttgttctttaaagaggaagtatggagatattgaagaagaagaatcaacctatttaagtaataattcagatgatgaatcagatgatgcgaagacacaagttcatgcgagaacaagaaagccggtgactaaaagaaaacgaagcacagaagtccataagttatatgaaagaaaacgaagagatgaattcaacaagaaaatgcgtgctttgcaggacctactaccaaattgttacaaggatgataaggcttcattgttggatgaggctatcaaatatatgcggacccttcaacttcaagttcagatgatgagtatgggaaatggattaataagaccacctacgatgttgccaatgggtcattactctcccatgggtctaggaatgcatatgggtgcagcagcaacaccaacatcaataccgcaattcctgcctatgaatgttcaagcaaccggttttccggggatgaacaatgcaccaccacaaatgctaagctttcttaatcacccaagtggactaattccaaacactcctatcttttctccattggaaaattgctctcagccattcgtggtgccttcgtgtgtttctcagactcaggctacttcttttactcaattcccaaagtctgcgtccgcctcaaacttagaagatgcaatgcaatatagaggaagcaacggttttagttattatcgctcgccaaac

SEQ ID NO: 108 - protein, 416 aa, Arabidopsis thaliana
  AT2G46970.1 (PIL1, G1649, bHLH domain 227-283)
MEAKPLASSSSEPNMISPSSNIKPKLKDEDYMELVCENGQILAKIRRPKNNGSFQKQRRQSLLDLYETEYSEGFKKNIKILGDTQVVPVSQSKPQQDKETNEQMNNNKKKLKSSKIEFERNVSKSNKCVESSTLIDVSAKGPKNVEVTTAPPDEQSAAVGRSTELYFASSSKFSRGTSRDLSCCSLKRKYGDIEEEESTYLSNNSDDESDDAKTQVHARTRKPVTKRKRSTEVHKLYERKRRDEFNKKMRALQDLLPNCYKDDKASLLDEAIKYMRTLQLQVQMMSMGNGLIRPPTMLPMGHYSPMGLGMHMGAAATPTSIPQFLPMNVQATGFPGMNNAPPQMLSFLNHPSGLIPNTPIFSPLENCSQPFVVPSCVSQTQATSFTQFPKSASASNLEDAMQYRGSNGFSYYRSPN

SEQ ID NO: 109 - DNA, 1089 bp, Arabidopsis thaliana
  AT3G62090.2
atgatgttcttaccaaccgattattgttgcaggttaagcgatcaagagtatatggagcttgtgtttgagaatggccagattcttgcaaagggccaaagatccaacgtttctctgcataatcaacgtaccaaatcgatcatggatttgtatgaggcagagtataacgaggatttcatgaagagtatcatccatggtggtggtggtgccatcacaaatctcggggacacgcaggttgttccacaaagtcatgttgctgctgcccatgaaacaaacatgttggaaagcaataaacatgttgacgattctgagactttgaaagcttcttcatcaaagaggatgatggttgattatcataaccgaaagaagatcaagtttatacctcctgatgagcaatccgtggttgctgataggtcgttcaaattgggctttgacacttcctccgtaggtttcactgaagacagtgaaggatcgatgtatctaagcagtagtctagatgacgagtcagatgatgcgaggccacaagttcctgcaagaacaagaaaagctttggtcaaaagaaaacgaaatgcagaagcgtataattcacctgagagaaatcaaagaaatgatatcaacaagaaaatgcgtactttgcaaaatctactacctaactctcacaaggacgacaacgaatcgatgttggatgaagcaatcaattatatgacaaaccttcaacttcaagttcagatgatgacgatgggtaacagatttgttacaccatcaatgatgatgcctttggggccgaactactctcagatgggtctagcaatgggtgtgggaatgcaaatgggcgaacaacagtttctgcctgcacatgttctaggagctggcttgcctgggattaatgattcagcagatatgctaaggtttcttaaccatcctggactaatgccaatgcaaaactctgcacctttcattccaacggaaaattgttccccacaatctgtccctccatcgtgcgctgctttccctaaccaaataccaaatcccaactctttgtcaaatttagatggtgcaaccttacacaagaaatcaaggaaaactaacaga

SEQ ID NO: 110 - protein, 363 aa, Arabidopsis thaliana
  AT3G62090.2 (bHLH domain 186-242)
MMFLPTDYCCRLSDQEYMELVFENGQILAKGQRSNVSLHNQRTKSIMDLYEAEYNEDFMKSIIHGGGGAITNLGDTQVVPQSHVAAAHETNMLESNKHVDDSETLKASSSKRMMVDYHNRKKIKFIPPDEQSVVADRSFKLGFDTSSVGFTEDSEGSMYLSSSLDDESDDARPQVPARTRKALVKRKRNAEAYNSPERNQRNDINKKMRTLQNLLPNSHKDDNESMLDEAINYMTNLQLQVQMMTMGNRFVTPSMMMPLGPNYSQMGLAMGVGMQMGEQQFLPAHVLGAGLPGINDSADMLRFLNHPGLMPMQNSAPFIPTENCSPQSVPPSCAAFPNQIPNPNSLSNLDGATLHKKSRKTNR

SEQ ID NO: 111 - DNA, 1524 bp, Citrus clementina
  clementine0.9_007946m
atgtctaatcaagaatttttggagcttgtgtgggaagatggtcaacttcgcatgcgaggttcttcaaagagaactcaaaagagcacttcctcgtgcattgatcatgcttctcgctcgtccaatgctcgtttggaaaatgggggaaatacagacacctttcctccaaagaatgagaaccaacatgaatcgctgcttgaaatatcgtataaaagccattttaatgcattttcggaacatgctacaggttataatattgattatgatgataagctacgcaaggactctcaagttgttccggtgcatgaaactaccccaactccaacgggtaaccgtcagtctcgtgattcaactccacttaaaaggccacgagttaaatacagcccgaatctactttcattggatgtattgaaaagagaacctgaaaagaaaagagagcagccagttaacttttctcttttcttgagatctccagcgctgcgaacaagcagtaggagaggtttctcaagagctgagcctgagaaggtgcaaaataagcctcgactgctatcgccagcagctaatggttcagcgagtgttaagggatttcagaaccagctgaattctgcagacacaaacgcggagctgttacaaccagtcccagtcacagtccccgatgtacaatcggaagctgattacagccgaacctcgagcttaccggctgagaatactgtcaaacgaaagctggatgctggaaaatgtatagaaccaccagttccgtcttcttccttatgctcacttggagcttcaaataataatcctgcgtgtactacttttaatttgaagaggagatatgaagataccgaggtatccgcttgtccttgtgaccaatatgagaagaaactggagagaaaagcagtgactgttcggggcagcaaaagtaaccggaaaaaacgaactcctgaagttcataagcgatatgaacggaagcgaagagataagatcaacaagaaaatgcgtgcattacaggagctcataccaaattgcaataaggtggacaaagcttcggtgcttgaggaggccattgattacttaaagactcttcagtttcaagtaatgatgatgtcaatgggaacaggggtttgtatgccttcgatgatgctacctacaggaataataggaatgcaacaaatgcatgcagttgcaccgcagatgagtcatttccctcccatgggaattggaatggacgggagaatgcaaatgggtgctggctgcaacccagcacagttcctaatgccacccattccaggagccactgctgtgcctggaatccagatgcctggctttcctggacagccgctgcccatgtccatgttacgcacaccattaggactaatgcacaaaacaaatccagttgccggcgtctctcgagctgctgcttcaatggaagtcaaggactctgcaccgctcacaaatcccggggattccaatcagaacgtagaaattaacaaaagaaacgttgagcaccacaagattcgaccttctgct

SEQ ID NO: 112 - protein, 508 aa, Citrus clementina
  clementine0.9_007946m (bHLH domain 306-365)
MSNQEFLELVWEDGQLRMRGSSKRTQKSTSSCIDHASRSSNARLENGGNTDTFPPKNENQHESLLEISYKSHFNAFSEHATGYNIDYDDKLRKDSQVVPVHETTPTPTGNRQSRDSTPLKRPRVKYSPNLLSLDVLKREPEKKREQPVNFSLFLRSPALRTSSRRGFSRAEPEKVQNKPRLLSPAANGSASVKGFQNQLNSADTNAELLQPVPVTVPDVQSEADYSRTSSLPAENTVKRKLDAGKCIEPPVPSSSLCSLGASNNNPACTTFNLKRRYEDTEVSACPCDQYEKKLERKAVTVRGSKSNRKKRTPEVHKRYERKRRDKINKKMRALQELIPNCNKVDKASVLEEAIDYLKTLQFQVMMMSMGTGVCMPSMMLPTGIIGMQQMHAVAPQMSHFPPMGIGMDGRMQMGAGCNPAQFLMPPIPGATAVPGIQMPGFPGQPLPMSMLRTPLGLMHKTNPVAGVSRAAASMEVKDSAPLTNPGDSNQNVEINKRNVEHHKIRPSA

SEQ ID NO: 113 - DNA, 1161 bp, Glycine max
  Glyma10g27910.1
gtcgtcacacgaatgactccctcgtgcgaaggttccttcaatgcaaaaagtgcaaggttaagctcactatactccctcatggacttcccagttcaaagggactctgccttggacaattctcaaccaaattctcatcaaagcaatgaccaaaattctgtgataaactcacctaaaggatcaccgggaagacaaaagaaccctttaaattctgatacatcaaacatggttccaagaagtgaggaaacaacacctcctgatgagcaatctgaagctgttggtcatgatagtattcatggatctcgtggtcaatattttaaccaaacctcaagctcagcaagacatagagcaaagggaaaagctcatgatactaaacaaaaatactgtgatgaaggcttgttggaatcttcttccctatgctccattggagcctcaaataacagaaacgtgtgtagcaggacacatgatgatatcgatgactcaacgtatttaagcaataatgatgaagaaccagaagatgtagtgaaggaaaagcctgcttgggaaggcaccggtgtcaagagaagtaggaatgcagaagttcataatttatgtgaaaggaagcgaagagataagatcaacaagaggatgcgtatattgaaggagctcataccaaattgcaataagacggacaaagcttcaatgcttgatgatgccatcgaatatcttaagaccctaaagcttcagttacagatgatgtcaatgggtgctggattttgtatgccgttcatgatgctacctaatgctgctcatcatatgatgaacacaccccatttacatcagttaatgggacttggtatggggttcaggccaggcacagccatgccttgtagcctccctcagttccctattacacctttgcatggtatcactgacaacagagttcacatgtttggtttccctaaccaagttccacccatgccaatttctcatgcacctttcattccaatgcttggaaatccttctacacaacccacccctcttgcaactagcacaaacatcaacctggcggaaaaccctgcttcttcccaagaagaaataaaatttagcatgtctaaggcaattgctagaaaagtcgatttaaagattgtgggatctgataataaatattcagcaactagacac

SEQ ID NO: 114 - protein, 387 aa, Glycine max
  Glyma10g27910.1 (bHLH domain 187-243)
VVTRMTPSCEGSFNAKSARLSSLYSLMDFPVQRDSALDNSQPNSHQSNDQNSVINSPKGSPGRQKNPLNSDTSNMVPRSEETTPPDEQSEAVGHDSIHGSRGQYFNQTSSSARHRAKGKAHDTKQKYCDEGLLESSSLCSIGASNNRNVCSRTHDDIDDSTYLSNNDEEPEDVVKEKPAWEGTGVKRSRNAEVHNLCERKRRDKINKRMRILKELIPNCNKTDKASMLDDAIEYLKTLKLQLQMMSMGAGFCMPFMMLPNAAHHMMNTPHLHQLMGLGMGFRPGTAMPCSLPQFPITPLHGITDNRVHMFGFPNQVPPMPISHAPFIPMLGNPSTQPTPLATSTNINLAENPASSQEEIKFSMSKAIARKVDLKIVGSDNKYSATRH

SEQ ID NO: 115 - DNA, 1683 bp, Populus trichocarpa
  POPTR_0014s10700.1
atggatgatcgcgggcatatggaattggtgtgggaaaatggtcaggttcttatgcgagtattgcccagtactagtagctcatgcaccagttacactcctcatcctaaaaaaaatgttagtgaagtcgagaataatagtgatggctacactacaaagaggccaaggttaggaactggggattctatcttgggcgactttcctttgatagatgatagagaactcgccaagcgtgacaaatcttcgcaagacgatcaccatccagagttattctctgaattatgtgaaactaatctcaatatgctcttggaaaataatgaaaataacatttatgagaagaatatcacggacgcccatgttgttccggggtataaagatgcaaattggcgaccggggaaggcgtccgagtttgcagctgaagttcctcagcttacaacagctagtaatggtcagctatatcagtctttcttggagcaacacaaagcttcagctccactattccatggattgcccacttcaaagctgcagcaggtggattctggatctgacaaccactcgaggttgcagaacttgtcccgcattttaaggccagctcttcctaaacctagtcatggcagtaatgcaacaagaccgacaagcggtcctggatcatcaagactccagcaactgaaaagcaacactgacgagcctccagcaggttgtagaaatcttgttgagtcgggacagatggtgccgacttatgcttcaaaagtttttaaatatttcaatgaccaacaatatctaatggcaagccagatagttcctattggaccaattgacaggtctgcagaagcgtcacccccagatgagcaatctgaagctgttctccataactatgccactaccagtaagaggtgctgcgatcgggttttcggttcaacctcaggctccgcagaaaaaaaaataaaggggaagcctgatagaggaaagtctatagatcaactgactgcaactagttcaatatgctcacgaggagcttcaaatgatccaacatcttctctagaaaggcaatatgaagacacagaggggacagcgtattcaagcgatgatcttgaggaagaagaacaagtacctgctcgagggagtgcaggttccaagagaaggcgagcaacagaaatccataatctgtctgaaaggaagagaagagataggatcaacaagaagatgcgtgcattacaagatctaatacccaattcaaataaggtggataaagcttctatgcttggtgaggcaatagactacctaaaatcccttcagcttcaagtacagatgatgtcgatgggaactaggctttgtatgcctctaatgatgttaccaacaggaatgcaacatatacatgcaccactattagctcaattttctcctatgggtgtggggatggatacgagattaatgcaaatgggtgttggatgcagtccagcaacattcccagcttcaggcatgtttgggctaccagctggtcagatgctacccatgtcggtatcacaagcgccattctttcctttgaatatcggagggcattccacacactcatctgttccgatgccggccatgtctggagtggccagtactcctctggaatttatgcgctcagctgtctttccaagttcaaaggatattattcactccaatacatcagctcgcaaa

SEQ ID NO: 116 - protein, 561 aa, Populus trichocarpa
  POPTR_0014s10700.1 (bHLH domain 379-435)
MDDRGHMELVWENGQVLMRVLPSTSSSCTSYTPHPKKNVSEVENNSDGYTTKRPRLGTGDSILGDFPLIDDRELAKRDKSSQDDHHPELFSELCETNLNMLLENNENNIYEKNITDAHVVPGYKDANWRPGKASEFAAEVPQLTTASNGQLYQSFLEQHKASAPLFHGLPTSKLQQVDSGSDNHSRLQNLSRILRPALPKPSHGSNATRPTSGPGSSRLQQLKSNTDEPPAGCRNLVESGQMVPTYASKVFKYFNDQQYLMASQIVPIGPIDRSAEASPPDEQSEAVLHNYATTSKRCCDRVFGSTSGSAEKKIKGKPDRGKSIDQLTATSSICSRGASNDPTSSLERQYEDTEGTAYSSDDLEEEEQVPARGSAGSKRRRATEIHNLSERKRRDRINKKMRALQDLIPNSNKVDKASMLGEAIDYLKSLQLQVQMMSMGTRLCMPLMMLPTGMQHIHAPLLAQFSPMGVGMDTRLMQMGVGCSPATFPASGMFGLPAGQMLPMSVSQAPFFPLNIGGHSTHSSVPMPAMSGVASTPLEFMRSAVFPSSKDIIHSNTSARK

SEQ ID NO: 117 - DNA, 768 bp, Brachypodium distachyon
  Bradi2g62067.1
atgggggaggaggccggcggcggcggcggaggggagtatgcgcgggtctcggagtgggagacggggctgccggggtccgacgagctcacccctctctcccagccgctggtcccgcccgggctggccgcggccttccgcatcccgccggagcccggccgcacgctgctcgacgtccaccgcgcctcctccgccaccgtctcccgcctccgctcctcctcctcttcttcctctggcgggggaggctcgttccccaccttcccctccggccacggcggggcggcgtcggacacgggcgcggactcggcggcggcggcgtcggagctggagaagacgagcaagcggccgcggatggtgtggaacccgcagctgcacaagcggttcgtggacgtggtggcgcacctggggatcaagagcgccgtgcccaagaccatcatgcagctgatgaacgtggaagggctcacccgggagaacgtcgccagccacctccagaagtaccgcctctacgtcaagcggatgcagggactctccaacgaaggtccttccccctccgaccacatcttcgcatccacccccgtcccgcccagcctccgcgagccacaggtgccctccgccgccatggcccccatgtaccaccaccaccccatgggcggcggcggcggcggcatgaccggcggctactaccagccgcagcagcagcacggcggacacgccgtctacaatggctacggcggcggcggaggctactcccagtaccaccacggcgaccag

SEQ ID NO: 118 - protein, 256 aa, Brachypodium distachyon
  Bradi2g62067.1 (SANT domain 116-166)
MGEEAGGGGGGEYARVSEWETGLPGSDELTPLSQPLVPPGLAAAFRIPPEPGRTLLDVHRASSATVSRLRSSSSSSSGGGGSFPTFPSGHGGAASDTGADSAAAASELEKTSKRPRMVWNPQLHKRFVDVVAHLGIKSAVPKTIMQLMNVEGLTRENVASHLQKYRLYVKRMQGLSNEGPSPSDHIFASTPVPPSLREPQVPSAAMAPMYHHHPMGGGGGGMTGGYYQPQQQHGGHAVYNGYGGGGGYSQYHHGDQ

SEQ ID NO: 119 - DNA, 714 bp, Oryza sativa
  LOC_Os01g74020.1
atgggcgaggaggcgccggaggagtacgagctgggcggcggggaggacgagcgggtgatggagtgggagacggggctgcccggcgccgacgagctgaccccgctgtcgcagccgctggtgccggcggggctggcggcggcgttccgcatcccgccggagcccgggcgcacgctgctcgacgtgcaccgcgcgtcggcggcgacggtgtcccggttgcggcgcgcgtcgtcgtcgtcgtcgagctcgttcccggcgttcgcgtcgaagggagcgggaacgggagcggacgaggcggagtcagggggaggcgcggatggggggaacgggaacaccaacaacagcagcagcaagagggcgcggctggtgtggacgccgcagctgcacaagaggttcgtggaggtggtggcgcacctggggatgaagaacgcggtgcccaagacgatcatgcagctgatgaacgtggagggcctcacccgggagaacgtcgccagccacctccagaagtatcgcctctacgtgaagcggatgcagggcctctccaacgagggcccttccccctccgaccacatcttcgcctccacccccgtcccccacgcctccctccacgaccaggttccttctccttaccacccccacccccaccaccactcctacaacaacgccgcctatgccgccaccgtctcctcctaccaccactaccaccacgccaaccac

SEQ ID NO: 120 - protein, 238 aa, Oryza sativa
  LOC_Os01g74020.1 (SANT domain 120-170)
MGEEAPEEYELGGGEDERVMEWETGLPGADELTPLSQPLVPAGLAAAFRIPPEPGRTLLDVHRASAATVSRLRRASSSSSSSFPAFASKGAGTGADEAESGGGADGGNGNTNNSSSKRARLVWTPQLHKRFVEVVAHLGMKNAVPKTIMQLMNVEGLTRENVASHLQKYRLYVKRMQGLSNEGPSPSDHIFASTPVPHASLHDQVPSPYHPHPHHHSYNNAAYAATVSSYHHYHHANH

SEQ ID NO: 121 - DNA, 657 bp, Zea mays
  GRMZM2G067702_T01
atgggcgaggaggcggtggacgactacgagctccacatggtgtgctacggcagcgacgaggacgagcgcgtgatggagtgggagtcggggctccctggcgccgacgagctgaccccgctctcgcagccgctggtgccgccggggctggccgcggcgttccgcatcccgccggagcccgggcgcaccctgctggacctgcaccgagcgtccgaagccacggtggcgcggctgcggcgcgcgccgccgtcgtcgccgggcacctcctcctccccccacggccaccaggaggcgagggggggcgaaggggcggactcggcggcggcgactaccacgaacagcaacagacggccccggctggtttggacgccgcagctgcacaagcggttcgtggacgtggtggcgcacctggggatcaagaaggcggtgcccaagaccatcatggagctgatgaacgtggaaggtctgacgcgggagaacgtggccagccacctgcagaagtaccggttgtacgtgaagcggatgcgggggcagggtccgtccccgtccgaccacatcttcgcacccacaccggtgcacggcgtcgccgtcggcatggtgcccatggtcagcggccaggcgtaccactacctgtacaacggaggagggggaggagacaga

SEQ ID NO: 122 - protein, 219 aa, Zea mays
  GRMZM2G067702_T01 (SANT domain 118-168)
MGEEAVDDYELHMVCYGSDEDERVMEWESGLPGADELTPLSQPLVPPGLAAAFRIPPEPGRTLLDLHRASEATVARLRRAPPSSPGTSSSPHGHQEARGGEGADSAAATTTNSNRRPRLVWTPQLHKRFVDVVAHLGIKKAVPKTIMELMNVEGLTRENVASHLQKYRLYVKRMRGQGPSPSDHIFAPTPVHGVAVGMVPMVSGQAYHYLYNGGGGGDR

SEQ ID NO: 123 - DNA, 759 bp, Setaria italica
  Si002653m
atgggcgaggaggcggttgacgactaccagctggagctgctcggcgacgaggagcgggtgatggagtgggagacggggctcccgggcgcggacgagctgaccccgctgtcccagccgctggtccccccggggctggcggcggcgttccgcatcccgccggagcccgggcggacgctgctggacgtgcaccgcgcgtccgcggcgacggtgtccaggctgcgctcttcgttggggagcggcggcggcacattccagccctttttgcatcccaatcaggcagccgcaggaggaggaggaggtggatcagcagcggcagcagcaggaagaggggacgaggcggactcgtccgcagctgccaccaccgcgaacaacagcaagcgccctcggctggtgtggacgccgcagctgcacaagcgcttcgtggacgtggtggcgcacctggggatcaagaacgcggtgcccaagacgatcatgcagctgatgaacgtggagggtctgacgcgggagaacgtcgcgagccacctgcagaagtaccggctgtacgtgaagcggatgcaggggctctccaacgaaggcccctccccctccgaccacatcttcgcctccacccccgtgccgcacagcctcgtccacgagccccaggcgcaggtgccagcgccaacgccctacttccccatgggcgtctccgtcggctaccaccaccaccaccaccagtaccaccacgccggctacccgcaggcgtaccaccacgccgacaaa

SEQ ID NO: 124 - protein, 253 aa, Setaria italica
  Si002653m (SANT domain 129-179)
MGEEAVDDYQLELLGDEERVMEWETGLPGADELTPLSQPLVPPGLAAAFRIPPEPGRTLLDVHRASAATVSRLRSSLGSGGGTFQPFLHPNQAAAGGGGGGSAAAAAGRGDEADSSAAATTANNSKRPRLVWTPQLHKRFVDVVAHLGIKNAVPKTIMQLMNVEGLTRENVASHLQKYRLYVKRMQGLSNEGPSPSDHIFASTPVPHSLVHEPQAQVPAPTPYFPMGVSVGYHHHHHQYHHAGYPQAYHHADK

SEQ ID NO: 125 - DNA, 972 bp, Arabidopsis thaliana
  AT3G46640.3
atgggagaggaagtacaaatgagcgattacgatgtttccggcgacggagatagggtttctgaatgggagatgggattaccaagcgacgaagatctagcatctctttcttactctctgattccaccgaatttggcgatggcgtttagtatcacaccggagagaagccgtacgattcaggatgtgaatcgtgcatcggagacgacgctctcgtcgctacgtggtggatcttcaggtccaaatacctcgtcgtcgaataataacgtggaggaggaagatcgagttggatctagcagtcctggatcggattcgaagaagcaaaagacatcaaacggtgatggagatgacggtggcggtgtggatccggattcggcgatggcggcggaagaaggagattcaggaactgaagatctatctgggaaaacacttaaacgaccgcgtttagtgtggacaccgcagctacacaagagattcgttgacgttgtagctcacttagggatcaaaaacgctgttccgaagacgattatgcagctgatgaacgttgaaggattaactcgtgagaacgttgcgtctcatcttcaaaagtataggctttacctcaaaaggatgcagggattgactaatgaaggtccctctgcttcggataagctcttctcttcaacacctgttcctccacagagcttccaagatatcggtggcggtggcggtagcagcggtaatgttggagtgccgattccgggggcgtatggaacgcaacagatgatgcagatgccagtttatgcacatcatatgggtatgcaaggatatcatcatcaaaatcataatcatgatccttatcatcagaatcatcgtcatcatcatggagctggtggaaatggttcttggtgtctacaaaatttcttatcttttgcggagttttccaccgcaaagtcccaaattgcatctgttcaggagaggatcatacaaagtatcatg

SEQ ID NO: 126 - protein, 324 aa, Arabidopsis thaliana
  AT3G46640.3 (PCL1, G2741, SANT domain 146-196)
MGEEVQMSDYDVSGDGDRVSEWEMGLPSDEDLASLSYSLIPPNLAMAFSITPERSRTIQDVNRASETTLSSLRGGSSGPNTSSSNNNVEEEDRVGSSSPGSDSKKQKTSNGDGDDGGGVDPDSAMAAEEGDSGTEDLSGKTLKRPRLVWTPQLHKRFVDVVAHLGIKNAVPKTIMQLMNVEGLTRENVASHLQKYRLYLKRMQGLTNEGPSASDKLFSSTPVPPQSFQDIGGGGGSSGNVGVPIPGAYGTQQMMQMPVYAHHMGMQGYHHQNHNHDPYHQNHRHHHGAGGNGSWCLQNFLSFAEFSTAKSQIASVQERIIQSIM

SEQ ID NO: 127 - DNA, 894 bp, Arabidopsis thaliana
  AT5G59570.1
atggggaaggaagttatggtgagcgattacggtgacgacgacggagaagacgccggcggcggcgatgaatataggattccggaatgggaaattggtttacccaacggagatgatttgactccgttatctcaatatctagtcccgtcgattctcgcgttagctttcagcatgatcccagaacgaagccgtacaattcacgacgtcaatcgcgcgtcgcaaatcacgctctcttcgttgagaagcagtaccaatgcttcgtctgtgatggaggaggtcgtggatcgagttgaatcgagtgttccaggatcagatccgaagaaacagaagaaatcggatggtggtgaagcagcggcggtggaggattccacggcggaggaaggagactccgggcctgaagacgcgtctgggaagacatcgaaacgaccgcgtttagtgtggacaccgcagctacacaagagatttgtggacgttgtggctcatctagggattaaaaacgcagtgccgaagacgattatgcagctgatgaacgtggaaggacttactcgtgagaacgttgcgtctcatttgcagaaatataggctttaccttaaacggattcaaggattgacgacggaagaagatccttattcgtcgtcggatcagctcttctcttcaacgccggttcctccacagagctttcaagacggcggaggaagtaacggaaagttgggggttccggttccggttccgtcgatggtgcctattccaggctatgggaatcaaatgggtatgcaaggatattatcaacagtatagtaaccatggcaatgaatcaaaccaatatatgatgcagcagaataagtttggaacaatggtgacatatccttctgttggtggtggtgacgtgaatgacaag

SEQ ID NO: 128 - protein, 298 aa, Arabidopsis thaliana
  AT5G59570.1 (SANT domain 143-193)
MGKEVMVSDYGDDDGEDAGGGDEYRIPEWEIGLPNGDDLTPLSQYLVPSILALAFSMIPERSRTIHDVNRASQITLSSLRSSTNASSVMEEVVDRVESSVPGSDPKKQKKSDGGEAAAVEDSTAEEGDSGPEDASGKTSKRPRLVWTPQLHKRFVDVVAHLGIKNAVPKTIMQLMNVEGLTRENVASHLQKYRLYLKRIQGLTTEEDPYSSSDQLFSSTPVPPQSFQDGGGSNGKLGVPVPVPSMVPIPGYGNQMGMQGYYQQYSNHGNESNQYMMQQNKFGTMVTYPSVGGGDVNDK

SEQ ID NO: 129 - DNA, 1134 bp, Citrus clementina
  clementine0.9_013078m
atgggcgaagaggtgaggatgacggagtatgaagttaacgataagggagactataacggcgatgacgagaggataccagagtgggagatgggattgcctaatggaacagatctaacgccgttatcacagtcgttaattccgcctgaactggcttccgcttttagcatcttacccgtaccttgccgaacgcacctcgacgtgaaccgcgcgtcgcagaccacgctctcctcgattcgtggcagccgcgcgcactcgctctcatcgacggacaataacaatagcaataacttaaagaccttaacggagaatcgcgacccgatggttaccgaaacggaagaacaggaccaaaacgggtcgtttgcggactcgaggtcgaagtcaaggagaccggattgtacggaggaggcggattcggcgctgaggacggacaattcgaacgaggatccgtcggcgaggactctgaagcggccgcgtctggtgtggaccccgcagctgcacaagcgattcgttgacgtggtggcgcatctagggattaagaacgccgtgccgaagacgatcatgcaactgatgaacgtcgagggattgacccgcgagaacgtcgcgagccacttgcaaaagtaccgcctttacttgaagcggatgcaagggctgtcgaacgacgacccgtcgtcgtccgatcaccagctgttcgcgtcaacgccggtgccgccccagtgtttgccttacgagagtaccaacggcgggccccatgtaggccacctctgtaacagtaacaataataacaataatgggagtattaataataacaataacaataatgatggaaatagtaataatgggagcggtaatagtggacacgtggggatggcggcgtacggtgctcccgcggggatgatgacggcgccgatgtatgggatgatcaaccatcaagggtttcatcatggacacgggtttgacccgagtatgtacaatatgaatatgaacatgggcatgggtatgaatatgaatatggggatgaataatatgatgcatcagcagagagactggtctgtgaataagcacgggtacgggcacgggcacgggcaggggtcggttgtgtcatacccgcagcatgtggcaccttccagtgataaa

SEQ ID NO: 130 - protein, 378 aa, Citrus clementina
  clementine0.9_013078m (SANT domain 158-208)
MGEEVRMTEYEVNDKGDYNGDDERIPEWEMGLPNGTDLTPLSQSLIPPELASAFSILPVPCRTHLDVNRASQTTLSSIRGSRAHSLSSTDNNNSNNLKTLTENRDPMVTETEEQDQNGSFADSRSKSRRPDCTEEADSALRTDNSNEDPSARTLKRPRLVWTPQLHKRFVDVVAHLGIKNAVPKTIMQLMNVEGLTRENVASHLQKYRLYLKRMQGLSNDDPSSSDHQLFASTPVPPQCLPYESTNGGPHVGHLCNSNNNNNNGSINNNNNNNDGNSNNGSGNSGHVGMAAYGAPAGMMTAPMYGMINHQGFHHGHGFDPSMYNMNMNMGMGMNMNMGMNNMMHQQRDWSVNKHGYGHGHGQGSVVSYPQHVAPSSDK

SEQ ID NO: 131 - DNA, 1134 bp, Citrus clementina; identical to SEQ ID NO: 129
  clementine0.9_013095m

SEQ ID NO: 132 - protein, 378 aa, Citrus clementina; identical to SEQ ID NO: 130
  clementine0.9_013095m (SANT domain 158-208)

SEQ ID NO: 133 - DNA, 1134 bp, Citrus clementina; identical to SEQ ID NO: 129
  clementine0.9_013088m

SEQ ID NO: 134 - protein, 378 aa, Citrus clementina; identical to SEQ ID NO: 130
  clementine0.9_013088m (SANT domain 158-208)

SEQ ID NO: 135 - DNA, 1008 bp, Eucalyptus grandis
  Eucgr.B02313.1
atgagcgaatccgacgacctccgccacggccgcggcggcggcagtggagatggcgagctggacggcgaggacccggtcgccgagtgggagttcggcctcccgagttgcgatgatctggcgccgttgtctcaggcgttgattccgcccgatctggcgtccgcgttcagcatcgcgctgcggccctcgagaaccgccggcgacgtcaatcgcgcgtcccggagcacgttgacgggattgcgccgctgcggcagcaccgcgtcttcgcagggtttttccaccaacgataatttcaagtccttcgttgatgatcgtcagagcatggaggtggaggtggaggaggaggagaaggaggaagaggaggaggaggaggaggaggaggaggaggatggtgccgataaatcggattccaggaaatcgaggaggattgagacggccgaagaagtggattccactccgaggatggatgattcgcaggaggatccgtcggagaagacatcaaagaggccacggctggtttggacacctcaattgcacaagaggtttgtcgacgtggttgcccatttagggatcaagaatgcggttccaaagactataatgcagttgatgaatgttgagggattgacaagggaaaatgtggcgagtcatctgcagaagtatagggtttacttgaggaggatgcaggggatgtcaagtgaaggactttcgtcatccgatcaattgtttacctcgactccggtggtgcatagcttgaattatgttgcaggcagcactggtcatggtgatgggcaaatgcccatgccgacaccggtgccctatggagcacagccgcctatgatgcctatgccagtttatgcaatggggcatggttatggacacatgagaatgcaaattggtgatttatctgggtttgagtcaaaccaatacgtgacgcaacagagagattggtccagtaataagtatggttcggttgcttcttaccaacagaccgcttcaaacgagaaacgattc

SEQ ID NO: 136 - protein, 336 aa, Eucalyptus grandis
  Eucgr.B02313.1 (SANT domain 170-220)
MSESDDLRHGRGGGSGDGELDGEDPVAEWEFGLPSCDDLAPLSQALIPPDLASAFSIALRPSRTAGDVNRASRSTLTGLRRCGSTASSQGFSTNDNFKSFVDDRQSMEVEVEEEEKEEEEEEEEEEEEDGADKSDSRKSRRIETAEEVDSTPRMDDSQEDPSEKTSKRPRLVWTPQLHKRFVDVVAHLGIKNAVPKTIMQLMNVEGLTRENVASHLQKYRVYLRRMQGMSSEGLSSSDQLFTSTPVVHSLNYVAGSTGHGDGQMPMPTPVPYGAQPPMMPMPVYAMGHGYGHMRMQIGDLSGFESNQYVTQQRDWSSNKYGSVASYQQTASNEKRF

SEQ ID NO: 137 - DNA, 918 bp, Populus trichocarpa
  POPTR_0001s25040.1
atgagtgaatacgaaatcaacgatgaagataacatcaacagggacgatgaaagaattgatgtgtgggagatgggattacctacaccttatgatctcactcctttatcacaactgttgatcccacctgaacttgcttccgccttcaacatctcccctgagcctcaccgtactccgctcgatgtcaaccgagcttcccagaacactctctccaatctccacggtcatttaaacgctctatcgtctaacaacttcaagtccttcaacgaaacgacagaggcggattcagccttgaggactgagaactgggtggatgacccgtcatctgctgcggcgaggactttgaaacggccacggctggtgtggaccccgcagttgcataagagatttgttgatgtggtgggccacttagggatgaaaaacgcggtcccgaaaacaattatgcagtggatgaatgtcgagggtttgactcgcgaaaatgtagctagtcatttgcaaaagtaccggctttatttgaagaggaaacaggggttgtcgagtgaaggaccctctgcttctgatcagttgtttgcgtccactccagtgccgcagagtttgcacgagagcggcggcggaagctgtgggggtgggaatttcggaatgccaattccaatgccttatcatcatcccgccaccacggctggtgggatgatgccaatgccggtttatggacatatggggatccaaatggtgaatgatcatgttcataataataataatagcaataattatcagcatcagcaagttagtatgaatagtcatcaaaatgggtataatggaaatgttgctttgctaatggggaataagcatagggattggaatgggactaattatggtccatactcgcatcatcctcatcatgcagtatctaatgataatatg

SEQ ID NO: 138 - protein, 306 aa, Populus trichocarpa
  POPTR_0001s25040.1 (SANT domain 118-168)
MSEYEINDEDNINRDDERIDVWEMGLPTPYDLTPLSQLLIPPELASAFNISPEPHRTPLDVNRASQNTLSNLHGHLNALSSNNFKSFNETTEADSALRTENWVDDPSSAAARTLKRPRLVWTPQLHKRFVDVVGHLGMKNAVPKTIMQWMNVEGLTRENVASHLQKYRLYLKRKQGLSSEGPSASDQLFASTPVPQSLHESGGGSCGGGNFGMPIPMPYHHPATTAGGMMPMPVYGHMGIQMVNDHVHNNNNSNNYQHQQVSMNSHQNGYNGNVALLMGNKHRDWNGTNYGPYSHHPHHAVSNDNM

SEQ ID NO: 139 - DNA, 1047 bp, Populus trichocarpa
  POPTR_0009s03990.1
atgggggaagaagtgaaaatgagtgaatacgaaatcaacgatggtgaagagaacatcaacggagacgatgaaagagttgcagtgtgggagataggattacctacacccgatgatctcactcccttatcacaaacgttgattccacctgaacttgcttcggccttcagtatcttccctgagcctcaccgtactccactcgatgttaaccgcgcttgtcagaccactctctccaatctccgcggtcaattaaacgccttatcgtctattaacttcaagtcgttcaacgaaacgacaggtcaaacgcacgaccctattgtagtcgatttagataataaaaccggagcggtggatcgggacgggtctggatccgaagcgaggaagttgaggagggttgattcggaagaggaagattcagctttgaggaccgataattcggcggaagacccgtcgtctgcggcggcgaggactttgaaacggccacggctcgtgtggacccctcagttgcataagaggtttgttgacgtggtcagccacttagggattaaaaacgcggttccgaaaacgattatgcagttgatgaatgttgaaggtttgactcgcgagaatgtagccagtcatttgcagaagtaccggctttatttgaagaggatgcaggggttgtcgagtgaaggaccttctgcttctgatcagttgtttgcgtccactcctttgccgcagagttttcccgagagtagtgatggcggcggcggcggaaatgggaattttggaatcccaattccgatgccttatcatcaccctgccacggcgggtgggatgatgccaatgccagtatatggacatatggggatgcaaatggggaataacaacggtcataataataatagtagtgataaccaccagcatcaccaagttagtattaatggtcatcaaaacgggtataatggaaatgttgttcatggtcatatgtttcagcagagggattggaatgggaatcattatggttcatacacgcatcatccacatcaagttgcacctaatgacaacatg

SEQ ID NO: 140 - protein, 349 aa, Populus trichocarpa
  POPTR_0009s03990.1 (SANT domain 161-211)
MGEEVKMSEYEINDGEENINGDDERVAVWEIGLPTPDDLTPLSQTLIPPELASAFSIFPEPHRTPLDVNRACQTTLSNLRGQLNALSSINFKSFNETTGQTHDPIVVDLDNKTGAVDRDGSGSEARKLRRVDSEEEDSALRTDNSAEDPSSAAARTLKRPRLVWTPQLHKRFVDVVSHLGIKNAVPKTIMQLMNVEGLTRENVASHLQKYRLYLKRMQGLSSEGPSASDQLFASTPLPQSFPESSDGGGGGNGNFGIPIPMPYHHPATAGGMMPMPVYGHMGMQMGNNNGHNNNSSDNHQHHQVSINGHQNGYNGNVVHGHMFQQRDWNGNHYGSYTHHPHQVAPNDNM

SEQ ID NO: 141 - DNA, 963 bp, Populus trichocarpa
  POPTR_0009s03990.2
atgggggaagaagtgaaaatgagtgaatacgaaatcaacgatggtgaagagaacatcaacggagacgatgaaagagttgcagtgtgggagataggattacctacacccgatgatctcactcccttatcacaaacgttgattccacctgaacttgcttcggccttcagtatcttccctgagcctcaccgtactccactcgatgttaaccgcgcttgtcagaccactctctccaatctccgcggtcaattaaacgccttatcgtctattaacttcaagtcgttcaacgaaacgacaggtcaaacgcacgaccctattgtagtcgatttagataataaaaccggagcggtggatcgggacgggtctggatccgaagcgaggaagactttgaaacggccacggctcgtgtggacccctcagttgcataagaggtttgttgacgtggtcagccacttagggattaaaaacgcggttccgaaaacgattatgcagttgatgaatgttgaaggtttgactcgcgagaatgtagccagtcatttgcagaagtaccggctttatttgaagaggatgcaggggttgtcgagtgaaggaccttctgcttctgatcagttgtttgcgtccactcctttgccgcagagttttcccgagagtagtgatggcggcggcggcggaaatgggaattttggaatcccaattccgatgccttatcatcaccctgccacggcgggtgggatgatgccaatgccagtatatggacatatggggatgcaaatggggaataacaacggtcataataataatagtagtgataaccaccagcatcaccaagttagtattaatggtcatcaaaacgggtataatggaaatgttgttcatggtcatatgtttcagcagagggattggaatgggaatcattatggttcatacacgcatcatccacatcaagttgcacctaatgacaacatg

SEQ ID NO: 142 - protein, 321 aa, Populus trichocarpa
  POPTR_0009s03990.2 (SANT domain 133-183)
MGEEVKMSEYEINDGEENINGDDERVAVWEIGLPTPDDLTPLSQTLIPPELASAFSIFPEPHRTPLDVNRACQTTLSNLRGQLNALSSINFKSFNETTGQTHDPIVVDLDNKTGAVDRDGSGSEARKTLKRPRLVWTPQLHKRFVDVVSHLGIKNAVPKTIMQLMNVEGLTRENVASHLQKYRLYLKRMQGLSSEGPSASDQLFASTPLPQSFPESSDGGGGGNGNFGIPIPMPYHHPATAGGMMPMPVYGHMGMQMGNNNGHNNNSSDNHQHHQVSINGHQNGYNGNVVHGHMFQQRDWNGNHYGSYTHHPHQVAPNDNM

SEQ ID NO: 143 - DNA, 798 bp, Solanum lycopersicum
  Solyc06g005680.2.1
atgggtgaagaagtgaaaattacggacggtgatggttacgccggagatgataatcgtgttggcgagtgggaagacggacttccgagttttgacgatctgacgccgttatctcaggttttaatcccgccggagttagcgtcggcgtttagaattacgccggagccggcgaagacgatgacggatgtgaatcgtgcttcggagagtacgttttcgtctctacgtgctggacagttacatatgttgtcggagaagtataattttaatgaaggaaggaatggagatagaaatcatgagaatgatgagatggatctgacgagagatggatccgagtcgaggaagacacggaggcttgacccggagatggttactgaagaggctgattcggcattgaggaatgagaattgtggagatgataattcagctaagacgctgaaacggccgcggttagtctggacgccacagctgcataagcgatttgtggatgttgtggcgcatttagggattaaaaatgctgtgccgaagacgattatgcagctgatgaatgtggaaggactgacgagggaaaatgttgctagtcatttacagaagtataggttgtatttgaagagaatgcaagggttgtcgaatgagggaccttcttcgtctgatcatttgttcgcttctacgcctgtgccacagagtttgcagcagtccggtggtaatggacacagtggtaatggtcatagtagtaatggtcatatgcctatgcctatgcctatgcctattacatggacatgggcacgggtttcatcatcagta

SEQ ID NO: 144 - protein, 266 aa, Solanum lycopersicum
  Solyc06g005680.2.1 (SANT domain 148-198)
MGEEVKITDGDGYAGDDNRVGEWEDGLPSFDDLTPLSQVLIPPELASAFRITPEPAKTMTDVNRASESTFSSLRAGQLHMLSEKYNFNEGRNGDRNHENDEMDLTRDGSESRKTRRLDPEMVTEEADSALRNENCGDDNSAKTLKRPRLVWTPQLHKRFVDVVAHLGIKNAVPKTIMQLMNVEGLTRENVASHLQKYRLYLKRMQGLSNEGPSSSDHLFASTPVPQSLQQSGGNGHSGNGHSSNGHMPMPMPMPITWTWARVSSSV

SEQ ID NO: 145 - DNA, 966 bp, Solanum lycopersicum
  Solyc06g076350.2.1
atgggtgaagaagtgagcctgaccgactatgaatcaagcggtggtaacgatgacagacttctctgggaaattggacttcccgatgtcgatgatctcacaccgttgaatatgcagttgattccgtcggaacttgctgctgcgttcagaatttcgccggaattgtcaaagacgatgaccgatgtaaatcgtgcttcgcagaatacgttttcttctctccagagatggcactcacaggatatggcttcgatgaataactctaatttcaagacgtttagctatgagaggagtagagaagagactgttactgaaagagatgaaacggatctgataagagagggatccgactcgaggaagctccggcgggttgaatccggaggcactgaggaggctgattcatctctgtgtaacgagaattttgcggatgattcgtctgctaagactctgaaacggcccagacttgtttggacgccgcagttacacaagcgctttattgaagtagtggcgcacttaggtatcaaaggggctgtgccgaaaacaattatgcagcttatgaatgtggaaggattgacgagagagaacgtagcaagtcatttacagaaatacagattgtatacgaagagaatgcagccgaacgagggtccttcttcgtctgatcatttgttgacttccacaccggctacagagattatgcgtgagtccagtgagagtggtcacctccgcaatactaatggccacatggcaatgccaactctgatgccgtaccaacaacaaatggtggcgatgccaatgatggggatgccaaatggaggacatgtaggcatgcctgttggttacgggggtggaccgccacttgggtttcatcatcactataatgtggtgcaacagcgggattggtctggaaataattttggttactatcatcctgttgcttctaatgataagtatgtagacctggatgatgtcatt

SEQ ID NO: 146 - protein, 322 aa, Solanum lycopersicum
  Solyc06g076350.2.1 (SANT domain 152-202)
MGEEVSLTDYESSGGNDDRLLWEIGLPDVDDLTPLNMQLIPSELAAAFRISPELSKTMTDVNRASQNTFSSLQRWHSQDMASMNNSNFKTFSYERSREETVTERDETDLIREGSDSRKLRRVESGGTEEADSSLCNENFADDSSAKTLKRPRLVWTPQLHKRFIEVVAHLGIKGAVPKTIMQLMNVEGLTRENVASHLQKYRLYTKRMQPNEGPSSSDHLLTSTPATEIMRESSESGHLRNTNGHMAMPTLMPYQQQMVAMPMMGMPNGGHVGMPVGYGGGPPLGFHHHYNVVQQRDWSGNNFGYYHPVASNDKYVDLDDVI

SEQ ID NO: 147 - DNA, 969 bp, Glycine max
  Glyma11g14490.1
atgggggaagaggtgaagacgagcgagtacgacgaagagcgcgtgatggagtgggaggcgggtctcccaactgccaacgatctcacgcctctctctcagccgctgatcccgccggaactcgcgtcggccttcagcatcttgccggagccccaccgcaccctcctcgacgtcaaccgcgcctctcgcaacacgctctccacgctccgcggcggcggagggagcgtgcaccaggccttctcctcctccaacaacaaccacaactacgacggcgacggcgacggaggcgtcgaggaggaggaggacgacgacgacgatcgcgacggctcggggccggattcacggaagcagcggaagatcgactgcggcgcggccgaggaggcggactcggcggttcagacggagacctcggcggagcggacggcggtgaagcggccgcggctggtgtggaccccacagcttcacaagaggttcgttgacgtggtggcgcacctcgggatcaagaacgcggtgccgaagacgattatgcaattgatgaacgtggaagggttgacccgcgagaatgtcgcaagccatctccagaagtatcgtctctacctgaaacggatgcagggtctctccaacgagggtccttctgcttcggatcagttatttgcgtcgacacctgtgcctcagagcttgcatgactctgctcctcccagtaaccatagcaatggtcatggtcatgggcatggccatagcaatggccgtggtcatggtcatggtcatggtcatggtcatctctctgttccgatgatgtccatgccatatccacctcccctgatgtccatgccatatccacctcccatgatgtcgggcatgccccatggccacatgggcatccccatgcctaattcctccgccacctcagcttaccatccttataatatgttgcatcaaagggattggcctcaccttgctcctaatgataaa

SEQ ID NO: 148 - protein, 323 aa, Glycine max
  Glyma11g14490.1 (SANT domain 146-196)
MGEEVKTSEYDEERVMEWEAGLPTANDLTPLSQPLIPPELASAFSILPEPHRTLLDVNRASRNTLSTLRGGGGSVHQAFSSSNNNHNYDGDGDGGVEEEEDDDDDRDGSGPDSRKQRKIDCGAAEEADSAVQTETSAERTAVKRPRLVWTPQLHKRFVDVVAHLGIKNAVPKTIMQLMNVEGLTRENVASHLQKYRLYLKRMQGLSNEGPSASDQLFASTPVPQSLHDSAPPSNHSNGHGHGHGHSNGRGHGHGHGHGHLSVPMMSMPYPPPLMSMPYPPPMMSGMPHGHMGIPMPNSSATSAYHPYNMLHQRDWPHLAPNDK

SEQ ID NO: 149 - DNA, 969 bp, Glycine max; identical to SEQ ID NO: 147
  Glyma11g14490.2

SEQ ID NO: 150 - protein, 323 aa, Glycine max; identical to SEQ ID NO: 148
  Glyma11g14490.2 (SANT domain 146-196)

SEQ ID NO: 151 - DNA, 918 bp, Glycine max
  Glyma12g06410.1
atgggggaagaggtgaagacgagcgagtacgacgaagagcgcgtgatggagtgggagatgggtctcccaaccgccaacgatctcacgcctctctcccagccgctgatcccgccggagctcgcttcggccttcagcatctcgccggagccccaccgcaccctcctcgaggtcaaccgcgcctcgcgcaacacgctctccacaatccgcggcggcggtagcgtgcaccaggccttctcatccaacaacaacaacaaccaccactacgacggcgacggagacggcggcgacgaggaggagtacgacgacgccgatcgcgatggctcggggtcggattcccggaagcagcggaagatcgactgcggcgtggcggaggaggcggactcggcggtgcggacagagacctcggcggagcgaacggcggtgaagcggccgcggctggtgtggaccccgcagcttcacaagaggttcgtggacgtggtggcgcacctcgggatcaagaacgcggtgccgaagacgattatgcaattgatgaacgtggaagggttgacccgcgagaatgtcgcgagccatctccagaagtatcgtctctacctgaaacggatgcagggcctttcgaacgagggcccttcttcttcggatcagttattcgcttccacagctgtgcctcagagtttgcatgactctgctcctcccagtgcccatagcaatggccatggtcatctccctgttcccatgatgtccatgccatatccccctcccatgatgtccatgccatacccccctcccatgatgtccggcatgccccatgcccatggccacatgggcatccccatgcctaattcctccgccacctcagcttaccatccttataacatgttgcatcaaagggattggcctcaccttgctcctaatgataaa

SEQ ID NO: 152 - protein, 306 aa, Glycine max
  Glyma12g06410.1 (SANT domain 145-195)
MGEEVKTSEYDEERVMEWEMGLPTANDLTPLSQPLIPPELASAFSISPEPHRTLLEVNRASRNTLSTIRGGGSVHQAFSSNNNNNHHYDGDGDGGDEEEYDDADRDGSGSDSRKQRKIDCGVAEEADSAVRTETSAERTAVKRPRLVWTPQLHKRFVDVVAHLGIKNAVPKTIMQLMNVEGLTRENVASHLQKYRLYLKRMQGLSNEGPSSSDQLFASTAVPQSLHDSAPPSAHSNGHGHLPVPMMSMPYPPPMMSMPYPPPMMSGMPHAHGHMGIPMPNSSATSAYHPYNMLHQRDWPHLAPNDK

SEQ ID NO: 153 - DNA, 1185 bp, Vitis vinifera
  GSVIVT01024916001
atgaaattacaactttgccccccacttataaatattagcttcctctcctcatttcagatcttcttctctcagttctcgttcctgtcgacgctagggtttttcctcccacttaatgcaaaaatccatcagataatccattcgaaaatccatcagatatttgcctcttcgtattcaccatatttgtggcctaccatcctggggttttgtggagccatttggacaatttctttattgggtttcatctcaaggactacactattttggaggcatcgagggattataagaggttggtgtatgagttttcaaagatgggttctcagttcaaccaattcgatgggcgaagaagtgaggatgagtgatattaacggaggtgatggcggcgatgacgagcgagtgctcgagtgggaggcggggctgcccgctgccgatgatctgactcccctatctcagccgttgatccctccggagctggcgtcggcgttcagcataacgccggagccgtgccgtacgctgctggaggtgaatcgtgcgtcgcagagtacgttttcgaccattcgagggcagtctcattcgttctcgtcgaacaatttcaagtctttcaacgaggagcgaaaccgcgagccagcggaggccgattcagcgatgaggacggagaattcgaacgatgatccctctgctcggacgctgaaacgaccccgtttggtttggactccgcagctccacaagcgattcgtggatgtggtggggcatctgggcatcaagaacgcggttccgaagacgattatgcaattgatgaacgtagagggcttgactcgggagaacgtcgccagtcatctacagaagtatcgactttacctgaaacggatgcaggggctgtctaacgagggtccatcttcgtccgaccatcttttcgcgtccacgccggtgccgcagagcttgcacgagtctggcggaagtgtgcatgggaacggtcatggaaatggtcacatgtctgttccaattcccatgccttatgggcagacgatgatgcacatgcccgttcttggagtgtcacatggccatggccaaatgggaatgtcaggtccaggtggatatcatggctacgagtctcatcatccttataatatgttgcagcagagagattggtcagttgtgtcgtacccaaatgtcggtcctaatgatcaa

SEQ ID NO: 154 - protein, 395 aa, Vitis vinifera
  GSVIVT01024916001 (SANT domain 233-283)
MKLQLCPPLINISFLSSFQIFFSQFSFLSTLGFFLPLNAKIHQIIHSKIHQIFASSYSPYLWPTILGFCGAIWTISLLGFISRTTLFWRHRGIIRGWCMSFQRWVLSSTNSMGEEVRMSDINGGDGGDDERVLEWEAGLPAADDLTPLSQPLIPPELASAFSITPEPCRTLLEVNRASQSTFSTIRGQSHSFSSNNFKSFNEERNREPAEADSAMRTENSNDDPSARTLKRPRLVWTPQLHKRFVDVVGHLGIKNAVPKTIMQLMNVEGLTRENVASHLQKYRLYLKRMQGLSNEGPSSSDHLFASTPVPQSLHESGGSVHGNGHGNGHMSVPIPMPYGQTMMHMPVLGVSHGHGQMGMSGPGGYHGYESHHPYNMLQQRDWSVVSYPNVGPNDQ

SEQ ID NO: 155 - DNA, 2459 bp, Arabidopsis thaliana
  AT1G33240 (G634)
ttactgaaccattgtcaagaaaggtggttccgtatggccattgcctcctctgtttgcagggctttgaaacgcaatctcgaaagccgcggacttctcatcctcgtctagttcttcctcatccatttcctgatcttcctcttcctccatgttattataattgtgagactcttcaatcttttcatactcacctatcattgattcttgttgttgtagttgctgttgttgttgaatcagctctctcatcacaaggtcttctggcttcaattccaacaaatcatatttcagttatcaaagaacattaaaccaatcacattttgacaaggaaaagcaaagtttgtaccttttctgttccttgtggactttcctctataggctcttcttcctcagttgaagctgacccatgagtttgttgaacattaacaagtccttcttgtggcggtttcatcgcagtgaccggactctgtttttggtcttgaggtagaccagaagtgctagaaccaccgccactaccgagtactttgttgcggtaaagaagatcgaggcggtgaaagtaaggacaagtcttagcatcttgaggacgtttcttgttgctttctttaactttcttgtagtatttgtttatgttttcccatttctctttacatctcttagcgtttctgttgtatcccattctcttcattgaagttgagatctcttcccatagaagtcctttaggtacattatcttggtaccttggttccattccacttctcaggtttataagcgctagaatctctgcctttggccatcttgatgatgatggtaatgatgattgttccgagctcatgaccatctcttgttgtggttgttgttgttgtttctgttctggttgatgagcgtgaggatgagaaggaggaggaggaggaagaatttgttgttgtggaatcgccattattggttgttgtgattgagattgagctgttgataatggtggttccgccacacgtttagtgaccgcgggtggcggttgatacggtggaggcggttgagatgacaaagaaggaggtaactgaatggtatggccagtaattttctgaatcaatgaaatgattgcggcgtcacgagaagcagaggcggctcgttcttgagacatgacctcgtgttctcgagctaaccgagccatttcttgacgtttccaagcttcttcacgatcaagacgttcttgctctctcttctcaagagcttccaagaaactcctttgcatagccgcttgcttttgcattacttgtctcaccaaaccttcaaacaattccatcattttaccgcctccaccgcggtttccacgtttgcgttttcggctactagaacccgcaatgttagcctgatcaacgtccatatcgtcgtcatcatcatcagaccccattcctgaagccgtcgatgagctatgagacgagaaagtaacaccggtaaatatcggacccattgaaggaagtggaagaggtggtggagtaggagtaaaagagacattatgcgtttgaggcggttgcgtttgcgtttgcggttgcggttgagagaatacgggaaatggagaagaagaagaagaaggcatgagaatgggattagcgacggagagaggagtaacgtcgagggaagatgaaggaggagtagtgttgagagcttcaagctgagagaagaacttgtaagctttaccatcatgacgaccaccgcgagtttctttagtacgtttgtaatatttctgaacgttttcgaatttctctttgcatttctttgaacttcgtttgtaacctaactccaatagcttcctgtttccaaaaacatgaaaataattcagattctctagttttattttatttttggttgtcgttattagctggaaaatttttatggttactgttcgatcggattttttttttttttttttggaagtaaagagagtcttgggattttcaaaatcgaaaacgtcccagaaactcatgaaccaacttctgtaataaacaaacagttcttttaatttttcttggggatggtgaagatgctttgatctcgaatatattactatttatatatacctaacactaaaaaaaaaaagttaacaaaaaaaaaacacatgcaaatggatctctatcaagaaacaccattgatgaaaatggaagagaagagaggaagagagacctggaaacatgttcccaaagaggagctttgagagtagcatcacgaaaagtagaatccatatcggatcggatccgaagaagagctaaagtttcttctctcggccatcgatttcccgatgaagaagaagcacttcctcctcctcctcctccacctccacctcctaatccaccgtcatccgcggcggctgagaatctcataagctcttctaagttgttagcaggaggtcttgaactaataggtgaagcttcctccacaacttcattaccaccaccacctcctccttgctc

SEQ ID NO: 156 - protein, 265 aa, Arabidopsis thaliana
  AT1G33240 (G634, trihelix AKA GT domains 60-143,187-259)
MEQGGGGGGNEVVEEASPISSRPPANNLEELMRFSAAADDGGLGGGGGGGGGGSASSSSGNRWPREETLALLRIRSDMDSTFRDATLKAPLWEHVSRKLLELGYKRSSKKCKEKFENVQKYYKRTKETRGGRHDGKAYKFFSQLEALNTTPPPPPSHPHAHQPEQKQQQQPQQEMVMSSEQSSLPSSSRWPKAEILALINLRSGMEPRYQDNVPKGLLWEEISTSMKRMGYNRNAKRCKEKWENINKYYKKVKESNNSNYNNKNQ

SEQ ID NO: 157 - DNA, 2274 bp, Brachypodium distachyon
  Bradi5g17150.1
atgcagcagcaccagggtggcgggtcccagtacggggcgccgccgccgcaggacatggggccgttctcgacggcgccgccggctcccggcccggtgccgctgagcagccggccgcccgcgccgacgcagcagcagcagccgacctacgaggaattggcggccgcgtccggcgcgggcgctggcagcggcggcttccccgacgacgacatgctcggcggcgacaacagcggcggcggtttgggcgcgagcggcggcaaccggtggccgcgggaggagacgctggctctcatcaggatccgctccgagatggacgctaccttccgcgacgccaccctcaagggtcccctctgggaagaggtctccaggaagcttgcggagttgggctacaagaggaacgccaagaagtgcaaggagaagttcgagaacgtgcacaagtactacaagcgcaccaaggaaggccgcaccggcaggcaggacggcaagagctaccgcttcttctctgagctcgaggcgctgcatgccaccaccaccgcgcagcaccaccaggagcagcagctgccgccggtcagcagcgccgccgccccgccgcagctgcagcacgccttcgcggcgcccgccgtatccgcgccgctgccgatgagcacaatgccgccgccaccggggccgatccagccggcgcccatatcttcggcggctccggcggcacatgtagcggagctccaccaggcaccaccgcccctcggcctgcaaggcttgagcttcccgtccatgtccgagtcagagtcggacgacgagtctgaggatgacgagatgacggcggagaccggcggcggcagcggcagccaggatggcctcggcaagcgcaagcacggcggcagcaagaagctgatggccttcttcgagggcctcatgaagcaggtcatccagaggcaagaggagatgcagcggcggttcctggagacgatggagaagcgagaggcggagcgcatggcaagggaggaggcgtggcgcaagcaggaggtggcccgcctgaaccgcgagcaggagatcctcgcgcacgagcgcgccgccgccgcgtcccgcgacgcgtccatcatcgccttcctccagcgcgtcggcgcggggcaagccgtgcaagtccccgcccccgtcgtcatcccgatgcccgcgccgatgcaggtccagaccccaaggcaacctcctcgacagcagctccctcctccgccgccgcccgcacaggccacggcgccaccgccgcagcccatcccagccgcgccgctccaacagcaaccgcctccaccacagccacagcacaaggaaacgacgatggcgcgccaagaggccgtgacaacgccgcgcagcgcgccgacaccgacaccgacaccggcttccgggggcacatcactggcgctggttcccgtctctgagcagcaggttgagagtcatggtctcggaggaggaggggatcatggcggggccgcgtcgtcgtcgcggtggcccaagacggaggtgcacgcgctgatccagctgcggatggacatggacaaccggtaccaggagaacgggcccaagggcccgctgtgggaggagatctcgtcggggatgcggcggctgggttacaacaggaacccgaagcggtgcaaggagaagtgggagaacatcaacaagtacttcaagaaggtaaaggagagcaacaagaggcggcccgaggactccaagacttgcccctacttccaccagctcgaggccatctaccgcaagaagcacaacggcgccggcgccgctgccgccgtgtccgccgccaacgccgccgccgtcgcgtctgtctgtgctgtcaccactgatcagcagcagtccctgagcctgaaccggcacgagatcgagggcaagaagatcaacgacaacgacaagaggaacaacggaggagttggaggagccacacagacgcaggtgccgaccagtaacggcgagacaacgccgacgacgaccccgccgctcgacttcagtgagaaaaagccagaagacactgtgagggagctgagcgagcagcagcagcaccgggagttcacgacggacgagaccgacagtgacgacatgggcgatgactacactgacggcgaggacggcgaggacgatggcaaaatgcagtacaggatacagttccagacgccaaaccccgtcggcactaacaatgcacctccaccggcaacgacccagacgaccgccgttccgccgacttcgactccatcgagctccttcctcgccatggttcag

SEQ ID NO: 158 - protein, 758 aa, Brachypodium distachyon
  Bradi5g17150.1 (trihelix AKA GT domains 85-168,496-580)
MQQHQGGGSQYGAPPPQDMGPFSTAPPAPGPVPLSSRPPAPTQQQQPTYEELAAASGAGAGSGGFPDDDMLGGDNSGGGLGASGGNRWPREETLALIRIRSEMDATFRDATLKGPLWEEVSRKLAELGYKRNAKKCKEKFENVHKYYKRTKEGRTGRQDGKSYRFFSELEALHATTTAQHHQEQQLPPVSSAAAPPQLQHAFAAPAVSAPLPMSTMPPPPGPIQPAPISSAAPAAHVAELHQAPPPLGLQGLSFPSMSESESDDESEDDEMTAETGGGSGSQDGLGKRKHGGSKKLMAFFEGLMKQVIQRQEEMQRRFLETMEKREAERMAREEAWRKQEVARLNREQEILAHERAAAASRDASIIAFLQRVGAGQAVQVPAPVVIPMPAPMQVQTPRQPPRQQLPPPPPPAQATAPPPQPIPAAPLQQQPPPPQPQHKETTMARQEAVTTPRSAPTPTPTPASGGTSLALVPVSEQQVESHGLGGGGDHGGAASSSRWPKTEVHALIQLRMDMDNRYQENGPKGPLWEEISSGMRRLGYNRNPKRCKEKWENINKYFKKVKESNKRRPEDSKTCPYFHQLEAIYRKKHNGAGAAAAVSAANAAAVASVCAVTTDQQQSLSLNRHEIEGKKINDNDKRNNGGVGGATQTQVPTSNGETTPTTTPPLDFSEKKPEDTVRELSEQQQHREFTTDETDSDDMGDDYTDGEDGEDDGKMQYRIQFQTPNPVGTNNAPPPATTQTTAVPPTSTPSSSFLAMVQ

SEQ ID NO: 159 - DNA, 2016 bp, Zea mays
  GRMZM2G169580_T01
atgctgcaccaccacggtggcgccgggtccccttacatggccccgacgacggctgacacgggcatggacccgttctcgccgacgccggcgacgcggcccgctgtgtctgtcaccgccataccacccccaccgacgatgcagttgcggccggcgggagcgggaccgagtgctgatttcgaggaattgccagcgggcggcgccggcgccggtgccgcggccagcctccaggacgacgacatgcagatgcaggccgactacggcgccagcgccgcgggagcgtccggctcgggcggcaaccggtggccgcgcgaggagacgctggcgctcatcaggatccggacggagatggacgccgacttccggaacgcccccctcaaagcgccgctctgggaggacgtcgccaggaagcttgccgggctgggctaccaccggagcgccaagaagtgcaaggagaagttcgagaacgtgcacaagtactacaagcgcaccaaggacgcccacgccgggcgccaggacggcaagagctaccgcttcttctcgcagctggaggccctgcacgccgcggcgccgcagccgcagcccccctcgggcatgaccacggtgcaagctggccctcatcatccgatggcattggcatggacggcgggccctacggcgctgggccctgccgctggcgccggcctgccggacctcagcttctcgtcgatgtcagggtcggagtccgagtacgactcggacgacgacgacgacgatgatgccggggaggagggcctcggcaggggcgagtaccacagggagatgatggcgatcttcgaggggatgatgaagcaggtcacggataagcaggacgccatgcagcgcgtgttcctggagacgctcgagcggtgggaggcggaacgcacagcgcgcgaggaagcgtggcggcgccaggaggtcgcccgcatgaaccgcgagcgcgagcggctcgccagggagcgcgccgccgcggcctcccgcgacgccgcgctgatcgcgttcctccagtgcgtcggcggtggtcaggggcagcccgtgcggctccctccacacagcgccggcgccagtgtcgtgcccgcgccgccaaagccggactgcgcccctccgtcgccccggctcgacgcggctgccacctcgcttcagcagctggtgcccgcgcagctcaaggcggtggaggccttggcgtgggcgggaggcgagggcggcgggtccacgtcgtcgcggtggcccaaggaggaagtggaggcgctgatccaggtgcggaacgagaaggacgagcagtaccatgatgcggggggcaaggggccgctttgggaggacatcgccgccgggatgcgcaggatcgggtacaaccgcagcgccaagcggtgcaaggagaagtgggagaacatcaacaagtactacaagaaggtgaaggagagcaacaagaggcgccccgaggactccaagacctgcccttacttccaccagctcgacgccatgtaccgcaagaaacaccgtggcgacagaggcagaataaccgcagctggaccgaacatgcaggacagcccgagccagcgcgagctcgagggaaagagcagcaacgatgttgacattgacaaccggaagagtgatgaacagggaaacgtgcatacttctcccgtcagcggcaaccgtgatacagcaccaacgaccacccggccgccaggtgacggcgccaaaaacaagacggcggaggacaacttgaaacgaacgaatgtgcagctcaagcaacaacagcatgagtttggaacggacgagacggacagcgacgacgacatggcaagaaaccacacagcctacactgaagaagacgacgacgaagccaaaataaaatacaagatggatttccagaatcctaatatgatagggagcagcagcaatatgtctgcaccaccaccacccgcagcagcagcagcgacgacggctgcggcaccgacgacttcagctgccccaacgagcaacaccttccttgccgttcag

SEQ ID NO: 160 - protein, 672 aa, Zea mays
  GRMZM2G169580_T01 (trihelix AKA GT domains 98-181,411-495)
MLHHHGGAGSPYMAPTTADTGMDPFSPTPATRPAVSVTAIPPPPTMQLRPAGAGPSADFEELPAGGAGAGAAASLQDDDMQMQADYGASAAGASGSGGNRWPREETLALIRIRTEMDADFRNAPLKAPLWEDVARKLAGLGYHRSAKKCKEKFENVHKYYKRTKDAHAGRQDGKSYRFFSQLEALHAAAPQPQPPSGMTTVQAGPHHPMALAWTAGPTALGPAAGAGLPDLSFSSMSGSESEYDSDDDDDDDAGEEGLGRGEYHREMMAIFEGMMKQVTDKQDAMQRVFLETLERWEAERTAREEAWRRQEVARMNRERERLARERAAAASRDAALIAFLQCVGGGQGQPVRLPPHSAGASVVPAPPKPDCAPPSPRLDAAATSLQQLVPAQLKAVEALAWAGGEGGGSTSSRWPKEEVEALIQVRNEKDEQYHDAGGKGPLWEDIAAGMRRIGYNRSAKRCKEKWENINKYYKKVKESNKRRPEDSKTCPYFHQLDAMYRKKHRGDRGRITAAGPNMQDSPSQRELEGKSSNDVDIDNRKSDEQGNVHTSPVSGNRDTAPTTTRPPGDGAKNKTAEDNLKRTNVQLKQQQHEFGTDETDSDDDMARNHTAYTEEDDDEAKIKYKMDFQNPNMIGSSSNMSAPPPPAAAAATTAAAPTTSAAPTSNTFLAVQ

SEQ ID NO: 161 - DNA, 2307 bp, Brachypodium distachyon
  Bradi3g30457.1
atgcagcagcagcagggaggaggaggagggccggggcagcagttcggcttgcatccgccggagatgccgccattctcgccggccgggcagcggatctcgatggcggaggcgccctcgcccatcagcagccgccccccggccccaccgggtcagcagcagctcagcagcaacgagctagcgggcgccgccgccgccatgagcttcgacgaagaggcgctggcggccggcgaggaaggcgggggcggcggctccggcggcaaccggtggccgcggcaggagacgctggtgctgctcaagatccggtccgacatggacgccgccttccgggacgccaccctcaagggaccgctctgggaagaagtctccaggaagctggcggaggaggggtaccggcggaacgccaagaagtgcaaggagaagttcgagaacgtgcacaagtactacaagcgcaccaaggacagccgcgccggccgcaacgacggcaagacctaccgcttcttccagcagctcgaggccctccaaggcgccacgcccggagccggggcgtcctcggtcccgccgccggccaccgccgtgcgggccccggccgagcctccgccgcagcctgttgttgctggtgccatgccgacgccgatgggcgtcggcaatctgagcttctcgacatccaacacggaggaattctccgaggacgaggacgaggaagatgactcggacgacgagggcacggacgacatggccgtggttgggaacaagaggaagcggatgtcgtcggacggagtcgcggcggcgggggggcataataacaagaagatgatgcgcttcttcgaggggctgatgcggcaggtgatggagcggcaggaggcgatgcagcagcggttcctggaggccatcgagaagcgggagcaggaccggatgatccgggaggaggcctggcggcggcaggagatggcccgcctcgcccgcgagcaggagaccctcgcccaggagcgcgccatggccgcctcccgcgacgccgccgtgctcggcttcatccagaagatcacgggccagtccgtccccatgcccatggcgccgccgccgccctccatcgccttcatgccgccaccgccggcggggtcccaccccacgcccatctccttctccgccgcgccgccatcgtcgtcccaatcgccggccacgcaggcctcgccgcggccgcagaagccgccaatgccgctgcccacgccggcgccgcagaagacgccggtgccggccacaccgccgccgcagcagcagagcggcggcatggagatggtggtctcggcgccggcgggcggggagctgcagctgcacgacggcgggtcggggtcggcttcgtcttcgaggtggcccaaggcggaggtgcacgcgctgatccagctgcggagcaacctggacacgcggtaccaggaggccgggccgaaagggccgctgtgggaggagatctcggcggggatgaggcggatggggtacagccggagctccaagcggtgcaaggagaagtgggagaacatcaacaagtacttcaagaaggtcaaggagagcaacaagaagcggcccgaggactccaagacctgcccctacttccaccagctcgaggcgctctaccgcaacaagcagcaagccgcgctcacctcgccatccgccgccgcggcgcccttgccggcccttgcagctcccccgccgccggagccgttcaccgtcgcggcgcccatctcgcagacgccgccgacgacgacgcacgccttgcagcagccggccgcggcgaagaacggcgcgggcaacgggcacgggaacgggaacggcagcggcgtcgcagcctgctcagaaggaggcagcgtctcggccggtggaatgcaggcaagcaacgggttcttcggcgaagccggcgtggcggcgaagaagccagaaggcatgatgaaggagacgatcatggagcagaggcagcaggcacaggcggccccgatcagcagcagctacaacaaccgagccggcgtcgtcgacagcgacaacagcatggacgacgaagacgactacgacgacgaagacgaggaggacgacgatgacgacgacgtggacgggaacaaaatgcagtacgagatccagttccagagccagcagcaccaccagcttcatcaacagcaccaccagcacaacaaccacaacgtcgtcaggccgaacgccggcgcggccggcggcggcaaccagccaggcgccgctgctcctcccagcgcggcatcggcggcggccgcgacgacgacggccgggtctttcctgggcatggtccag

SEQ ID NO: 162 - protein, 769 aa, Brachypodium distachyon
  Bradi3g30457.1 (trihelix AKA GT domains 86-169,453-537)
MQQQQGGGGGPGQQFGLHPPEMPPFSPAGQRISMAEAPSPISSRPPAPPGQQQLSSNELAGAAAAMSFDEEALAAGEEGGGGGSGGNRWPRQETLVLLKIRSDMDAAFRDATLKGPLWEEVSRKLAEEGYRRNAKKCKEKFENVHKYYKRTKDSRAGRNDGKTYRFFQQLEALQGATPGAGASSVPPPATAVRAPAEPPPQPVVAGAMPTPMGVGNLSFSTSNTEEFSEDEDEEDDSDDEGTDDMAVVGNKRKRMSSDGVAAAGGHNNKKMMRFFEGLMRQVMERQEAMQQRFLEAIEKREQDRMIREEAWRRQEMARLAREQETLAQERAMAASRDAAVLGFIQKITGQSVPMPMAPPPPSIAFMPPPPAGSHPTPISFSAAPPSSSQSPATQASPRPQKPPMPLPTPAPQKTPVPATPPPQQQSGGMEMVVSAPAGGELQLHDGGSGSASSSRWPKAEVHALIQLRSNLDTRYQEAGPKGPLWEEISAGMRRMGYSRSSKRCKEKWENINKYFKKVKESNKKRPEDSKTCPYFHQLEALYRNKQQAALTSPSAAAAPLPALAAPPPPEPFTVAAPISQTPPTTTHALQQPAAAKNGAGNGHGNGNGSGVAACSEGGSVSAGGMQASNGFFGEAGVAAKKPEGMMKETIMEQRQQAQAAPISSSYNNRAGVVDSDNSMDDEDDYDDEDEEDDDDDDVDGNKMQYEIQFQSQQHHQLHQQHHQHNNHNVVRPNAGAAGGGNQPGAAAPPSAASAAAATTTAGSFLGMVQ

SEQ ID NO: 163 - DNA, 2259 bp, Setaria italica
  Si034382m
atgcagcagccgggcatgccgccattctcgcctgccgccgggacgccggtgggggcggccgccacgccggcggctgctccgtcgcccatcagcagccggccaccggagggacagcagcagcagcaggtcgacgagctcgcaggaggaggcggcagcttcgccgaccacgagggcagcatgtccgcgggaggcgacgagggcgagcgcggcgggccgtcgggcaaccggtggccgcggcaggagacgctggcgctgctcaagatccgctcggagatggacgccgccttcagggaggccgcgctgaagggacccctctgggagcaagtctccaggaagctggaggccatgggctacaagcggagcgccaagaagtgccgcgagaagttcgagaacgtcgacaagtactacaagcgcaccaaggacggccgcgccggccgcggcgacggcaaggcataccgcttcttctccgagctcgaggcgctccacggcgcttcttcctcgccggcgccgcacccgccgccgccgtcgtctctcgcgccgacacctgtggccatggcgccgccggccacgccgctccccgttctgcagggtgttcccggcatggcgccggccatgcacgccgaacatcagccgactcgcgtcgccgccgtgcctcagccggcgccgctgatgagcggcaccactgcgcctgcggccgtcgccagcgacgcggcatgcatgatgacccccggtgacgtgagcttctcgtcgggctcggacggggaggacacggaggacacgggcgacggcgggaagcggaagcggcagggcggggacgtcggcggcggcggcagcggcagcggcaagatgatgcggttcttcgaggggctgatgcgccaggtgatggagcggcaggaggagatgcagcagcggttcatcgaggccatcgaaaggcgggagcaggaccggatgatacgcgaggaggcgtggcggcgccaggaggtggcgcgcctcgcccgcgagcaggacgcgctcgcccaggagcgcgccatggccgcgtcccgcgacgccgccgtcgtctccttcatacaacgggtcaccggccagaccatcccgatgccctccgtcgcgccgccggtcttcatcagcgcgctgacgccgccgcccctgcagcccactccggtggcttccgctgcaccagcggcggcaccggcgcagcaccagcaaccgccatcaattcatctgtcgccgaagcctggaaaaccgcacccacaaccgcatcagacgcaaccgccgctggcgcagctacagatgagcagcaaggagatgatcgtccgtgcgccgccggccgagtcgcaggagacgccggggtccggtggcggcgcgccgtcgccgtctcggtggcccaaggcggaggtgcacgcgttgatccagctgcggacggagctggaggcgcggtaccaggactcggggcccaagggcccgctgtgggaggacatctcggcggggatgcggcggctggggtacaaccggagcgccaagcgctgcaaggagaagtgggagaacatcaacaagtacttcaagaaggtgaaggagagcaacaagaagcgccccgaggactccaagacctgcccctactaccaccagctcgaagcactctaccgcagcaaggcgctcgcctcctccgccgctcctccgcccccggcggatcagcaggcggcaggtgtcaccgtgctcgccgcggtgccactctcccagacgccgccgcacgccgagcatggcggcaaggactgcagcaacggtaacgggaacgggtgcgcggcgggtaggggcggctcggacaataatggcggcagctccgggggcatgcaaacgcaggcgagcaacggcggtgttgcggccaggttctccgtcgaaggcgccggcggcaatggcgtcgcgacgaacaagcagccagaaggcatcatcacgaaggagacggcggcgacgacggagccgaggccgcagccggtgtcgatgaacgacagctacgtgaacgacaccgtggacagcgacagcagcatggacgacgatgatgacgaggacgacttcgacgacgacgacgagggcaacgtcggcggcggcaacagcaagatgcagtacgagatccagttccagcggcagcagcagagccagagcagcgtcgtccggccgaacgcgagcggcggcgccgggtcagggccgggcggcccaggcccggcagcaacagcaagtgggtctttcttgaccatggtccatcac

SEQ ID NO: 164 - protein, 753 aa, Setaria italica
  Si034382m (trihelix AKA GT domains 74-157,458-542)
MQQPGMPPFSPAAGTPVGAAATPAAAPSPISSRPPEGQQQQQVDELAGGGGSFADHEGSMSAGGDEGERGGPSGNRWPRQETLALLKIRSEMDAAFREAALKGPLWEQVSRKLEAMGYKRSAKKCREKFENVDKYYKRTKDGRAGRGDGKAYRFFSELEALHGASSSPAPHPPPPSSLAPTPVAMAPPATPLPVLQGVPGMAPAMHAEHQPTRVAAVPQPAPLMSGTTAPAAVASDAACMMTPGDVSFSSGSDGEDTEDTGDGGKRKRQGGDVGGGGSGSGKMMRFFEGLMRQVMERQEEMQQRFIEAIERREQDRMIREEAWRRQEVARLAREQDALAQERAMAASRDAAVVSFIQRVTGQTIPMPSVAPPVFISALTPPPLQPTPVASAAPAAAPAQHQQPPSIHLSPKPGKPHPQPHQTQPPLAQLQMSSKEMIVRAPPAESQETPGSGGGAPSPSRWPKAEVHALIQLRTELEARYQDSGPKGPLWEDISAGMRRLGYNRSAKRCKEKWENINKYFKKVKESNKKRPEDSKTCPYYHQLEALYRSKALASSAAPPPPADQQAAGVTVLAAVPLSQTPPHAEHGGKDCSNGNGNGCAAGRGGSDNNGGSSGGMQTQASNGGVAARFSVEGAGGNGVATNKQPEGIITKETAATTEPRPQPVSMNDSYVNDTVDSDSSMDDDDDEDDFDDDDEGNVGGGNSKMQYEIQFQRQQQSQSSVVRPNASGGAGSGPGGPGPAATASGSFLTMVHH

SEQ ID NO: 165 - DNA, 2112 bp, Populus trichocarpa
  POPTR_0001s45870.1
atgcaacaaggaggtggagaaagagggtcatcacagtcacaatatgcagtgccacagcaacagcaacaacaaggtgatatgcctttacctccttctacatctgctgcactggcaacccacatgcagcagcagcaacaagtcgtagaagaagcatcacccattagcagcagacctcctgccactgctgccacaacaagtggtggtggtgttatgaatttggatgagtttatgagactttcaggtggtggtggtggtgcagaagaagatattgctggagaagatgcagatcgaacaggaggtattgctagtggcaataggtggccaaggcaagaaacacttgcccttttgcaaattaggtctgaaatggatgctgcttttcgtgatgccaccttaaagggtcctctatgggaggatgtttcaaggaagctagcagagatgggatacaagagaagtgccaagaaatgcaaagaaaagtttgagaacgtgcacaagtattacaaaagaacaaaggaaggtagagctggtcgtcaagatgggaaaagctataggttttttagccagcttgaagctttgcagaatactggtggtggtggtggtgtttcttctagcatcagcaatgtgtctggtgttgctcctcagctgattggcactgcaacaacaagcagcctagatgttgctcctgtttctgttgggattcctatgcctataagaactcctccaccttcttctcaggtgcctcaaccagcttcaaatattggttccatgtttcctcctgatttgggggcaacagtggcgcgtgcagctgctgcaggtgccccggttcgaatcagcttctcgtcgaatgagtcttcttcctctcaaagttctgaagatgacgacgacgacgaggatgaaggtatattaggaggacaaacatcagccatgggtgctggtacaagtcgaaaacgtaaaagggcatcattatcatcgtcgaaaggagaaacacatcgtatgatggagttttttgaggggctaatgaagcaggttatgcaaaagcaagaggcaatgcaacagagatttttggaggcgattgagaagagggaacaagataggatgataagggatgaagcttggaaaaggcaagaaatggctagattgagtcgtgaacatgagattatggctcaagaacggtctatttcggctagtcgagatgcagctattgttgcctttctacagaaaattactggccaaactattcatttgcctacgcctgtatcaattgctcctctagtttcacaaccacaaccaccaccaccaacacagccacaacaggttcaaatagcgccattggtcactgtctcaacacaaccaccactgcaaccgcaacccatgccactgtcacaagtaacaccacaacaaaataagcaactaccccaacagcaacatcaccaacaacagcagcaccaacaagttcatcatcaacaccaaccaccatccatttcttcagaaatagtaatggcggtcccggaacaacaaatagcaccactggaacttggaagtggtgggagcgaaccagcatcatcaagatggccaaagccagaagttcttgcacttataaagttgagaagtgggcttgaaactagataccaagaagctgggcctaagggaccactttgggaagaaatctcagcagggatgctaaggttgggctataaaagaagttccaaaagatgcaaagagaaatgggagaatatcaataagtatttcaagaaagttaaagagagtaacaagaaacggacagaagatgccaagacttgcccttattttcatgaacttgatgccctttataggaaaaagatacttggaagcagtagtggtggtgcgggaagcacctccactagtggctttgacagccaaattaataggccacaaaaacagcagcaccagcatcaagagagcttagaattggatccaatgccacctccaatgcagcagacagtgccgcaacagacacaagccacagaatcacaaaacaaaaatggggctagtgttgatgttcaagcaagcaacacagttttagcaggaagcccctttggagaaggaaatggaggagcagaaaagaagaagacatcg

SEQ ID NO: 166 - protein, 704 aa, Populus trichocarpa
  POPTR_0001s45870.1 (trihelix AKA GT domains 104-187,520-604)
MQQGGGERGSSQSQYAVPQQQQQQGDMPLPPSTSAALATHMQQQQQVVEEASPISSRPPATAATTSGGGVMNLDEFMRLSGGGGGAEEDIAGEDADRTGGIASGNRWPRQETLALLQIRSEMDAAFRDATLKGPLWEDVSRKLAEMGYKRSAKKCKEKFENVHKYYKRTKEGRAGRQDGKSYRFFSQLEALQNTGGGGGVSSSISNVSGVAPQLIGTATTSSLDVAPVSVGIPMPIRTPPPSSQVPQPASNIGSMFPPDLGATVARAAAAGAPVRISFSSNESSSSQSSEDDDDDEDEGILGGQTSAMGAGTSRKRKRASLSSSKGETHRMMEFFEGLMKQVMQKQEAMQQRFLEAIEKREQDRMIRDEAWKRQEMARLSREHEIMAQERSISASRDAAIVAFLQKITGQTIHLPTPVSIAPLVSQPQPPPPTQPQQVQIAPLVTVSTQPPLQPQPMPLSQVTPQQNKQLPQQQHHQQQQHQQVHHQHQPPSISSEIVMAVPEQQIAPLELGSGGSEPASSRWPKPEVLALIKLRSGLETRYQEAGPKGPLWEEISAGMLRLGYKRSSKRCKEKWENINKYFKKVKESNKKRTEDAKTCPYFHELDALYRKKILGSSSGGAGSTSTSGFDSQINRPQKQQHQHQESLELDPMPPPMQQTVPQQTQATESQNKNGASVDVQASNTVLAGSPFGEGNGGAEKKKTS

SEQ ID NO: 167 - DNA, 2007 bp, Arabidopsis thaliana
  AT1G33240.1
atggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctccttcatcttccctcgacgttactcctctctccgtcgctaatcccattctcatgccttcttcttcttcttctccatttcccgtattctctcaaccgcaaccgcaaacgcaaacgcaaccgcctcaaacgcataatgtctcttttactcctactccaccacctcttccacttccttcaatgggtccgatatttaccggtgttactttctcgtctcatagctcatcgacggcttcaggaatggggtctgatgatgatgacgacgatatggacgttgatcaggctaacattgcgggttctagtagccgaaaacgcaaacgtggaaaccgcggtggaggcggtaaaatgatggaattgtttgaaggtttggtgagacaagtaatgcaaaagcaagcggctatgcaaaggagtttcttggaagctcttgagaagagagagcaagaacgtcttgatcgtgaagaagcttggaaacgtcaagaaatggctcggttagctcgagaacacgaggtcatgtctcaagaacgagccgcctctgcttctcgtgacgccgcaatcatttcattgattcagaaaattactggccataccattcagttacctccttctttgtcatctcaaccgcctccaccgtatcaaccgccacccgcggtcactaaacgtgtggcggaaccaccattatcaacagctcaatctcaatcacaacaaccaataatggcgattccacaacaacaaattcttcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaagaaacgtcctcaagatgctaagacttgtccttactttcaccgcctcgatcttctttaccgcaacaaagtactcggtagtggcggtggttctagcacttctggtctacctcaagaccaaaaacagagtccggtcactgcgatgaaaccgccacaagaaggacttgttaatgttcaacaaactcatgggtcagcttcaactgaggaagaagagcctatagaggaaagtccacaaggaacagaaaagccagaagaccttgtgatgagagagctgattcaacaacaacagcaactacaacaacaagaatcaatgataggtgagtatgaaaagattgaagagtctcacaattataataacatggaggaagaggaagatcaggaaatggatgaggaagaactagacgaggatgagaagtccgcggctttcgagattgcgtttcaaagccctgcaaacagaggaggcaatggccatacggaaccacctttcttgacaatggttcag

SEQ ID NO: 168 - protein, 669 aa, Arabidopsis thaliana
  AT1G33240.1 (GTL1, G634, trihelix AKA GT domains: 60-143, 433-517)
MEQGGGGGGNEVVEEASPISSRPPANNLEELMRFSAAADDGGLGGGGGGGGGGSASSSSGNRWPREETLALLRIRSDMDSTFRDATLKAPLWEHVSRKLLELGYKRSSKKCKEKFENVQKYYKRTKETRGGRHDGKAYKFFSQLEALNTTPPSSSLDVTPLSVANPILMPSSSSSPFPVFSQPQPQTQTQPPQTHNVSFTPTPPPLPLPSMGPIFTGVTFSSHSSSTASGMGSDDDDDDMDVDQANIAGSSSRKRKRGNRGGGGKMMELFEGLVRQVMQKQAAMQRSFLEALEKREQERLDREEAWKRQEMARLAREHEVMSQERAASASRDAAIISLIQKITGHTIQLPPSLSSQPPPPYQPPPAVTKRVAEPPLSTAQSQSQQPIMAIPQQQILPPPPPSHPHAHQPEQKQQQQPQQEMVMSSEQSSLPSSSRWPKAEILALINLRSGMEPRYQDNVPKGLLWEEISTSMKRMGYNRNAKRCKEKWENINKYYKKVKESNKKRPQDAKTCPYFHRLDLLYRNKVLGSGGGSSTSGLPQDQKQSPVTAMKPPQEGLVNVQQTHGSASTEEEEPIEESPQGTEKPEDLVMRELIQQQQQLQQQESMIGEYEKIEESHNYNNMEEEEDQEMDEEELDEDEKSAAFEIAFQSPANRGGNGHTEPPFLTMVQ

SEQ ID NO: 169 - DNA, 1740 bp, Populus trichocarpa
  POPTR_0005s21410.1
atgctaggggactcaagtagtgtgctagcaaccacgacaacgtcaacccctggtggtggtggtggtggagggggggcaggagatcataaggaagctcctccgttaaccggaggcaatcatgaaggaggcagtaatgatgttggaggtgaagaagataaaggaaaaattgaaggtgaccggagttatggaggaagccggtggccaagacaagagactttggccctcttaaaaataaggtccggcatggatgttgcgtttcgtgatgctagtgttaaaggtcctttatgggaggaggtttccaggaagctagcagagcttggttacaatcgaagcggcaagaagtgcaaagagaaattcgagaacgtgtacaagtaccacaaaagaaccaaagatggtcgaactggtaaacaagaaggcaaaacttataggttttttgatcaattagaagccttcgaaagtcgtcctccttcactatcatcgccgctgtcgctgcccccacaaccgcccaaagcacctactccagcagtcacagcaatagcaatgccagtggttaatccttctcctaatattgttagggcttctcacacaattatatatcttaccgttcctccatttccttcaacaaaccctacaatcttacccccatcacaagcaacaaaccctacaaatcctcctcatactaatactccaccctcttttccaaacttctccccagatctcatctccaattccacttcttcatcgacatcctcggacgtggaactgcaagagcgtcgtaagaggaaaaggaaatggaaggacttctttgaaaggctcatgaaggaggtgatccagaagcaagaggagatgcagaagaagttcttggaagcaattgagagacgcgaacatgaaagaatggttagagaagaatcttggagaatgcaggaaatgacaagaatcaatagagagcgcgagatcttagcccaagaaagatccgttgcggcgagtaaagatgctgcggtaatggcatttttgcaaaaattatccgaagagcaaaatccgggtcaaatacaaaataatccaccaccatcacagccaccgcggccaccagcacctcctccaatatcgccgccacttcaaggggcacaagcgccactaccacaagcggtggctaatgtggacatgataatgaaatcagataatggggatcagaattttacgtcagctagcccttctagatggcctaaagtagaagtcgaagctttaattaggataaggactaatcttgattgcaagtaccaggacaacggacctaaagggccactatgggaggagatctcagctaggatgagaaagcttggttacaatcgtaatgcaaaaagatgcaaagagaagtgggagaatatcaacaagtacttcaagaaagtgaaagagagtaaaaagaaaaggcctgaggattcgaaaacatgtccatactttcagcagcttgatgctttgtataaagagaagaacaagattgatggtccgtccaatatgaagcctgaaaactcagtgcctttgatggtacgccctgagcaacaatggcctcctccacaacaagaacataggcctgattcggagatggaagatctggaaagcgatgatcatcaaaatcatgacgacgaagatgacaagaacatggatgatgaagatgaagaagaagatgaagctagtggctatgaagttgtagcaaacaaacaaacatcaatgaacacggatgag

SEQ ID NO: 170 - protein, 580 aa, Populus trichocarpa
  POPTR_0005s21410.1 (trihelix AKA GT domains 64-147,404-488)
MLGDSSSVLATTTTSTPGGGGGGGGAGDHKEAPPLTGGNHEGGSNDVGGEEDKGKIEGDRSYGGSRWPRQETLALLKIRSGMDVAFRDASVKGPLWEEVSRKLAELGYNRSGKKCKEKFENVYKYHKRTKDGRTGKQEGKTYRFFDQLEAFESRPPSLSSPLSLPPQPPKAPTPAVTAIAMPVVNPSPNIVRASHTIIYLTVPPFPSTNPTILPPSQATNPTNPPHTNTPPSFPNFSPDLISNSTSSSTSSDVELQERRKRKRKWKDFFERLMKEVIQKQEEMQKKFLEAIERREHERMVREESWRMQEMTRINREREILAQERSVAASKDAAVMAFLQKLSEEQNPGQIQNNPPPSQPPRPPAPPPISPPLQGAQAPLPQAVANVDMIMKSDNGDQNFTSASPSRWPKVEVEALIRIRTNLDCKYQDNGPKGPLWEEISARMRKLGYNRNAKRCKEKWENINKYFKKVKESKKKRPEDSKTCPYFQQLDALYKEKNKIDGPSNMKPENSVPLMVRPEQQWPPPQQEHRPDSEMEDLESDDHQNHDDEDDKNMDDEDEEEDEASGYEVVANKQTSMNTDE

SEQ ID NO: 171 - DNA, 1932 bp, Glycine max
  Glyma20g30640.1
atgctcggggactcagctctgttgggaggaggaggaggagaaggtggtgcctccgccgatgtagtggcggcgaccgccacgcatgatgcgacaacgacgacgacgaccggaggaggcggtggcggatcaaataattcgggggacgatgagaggggtagaatcgaagaaggtgaacgtagcttcggcggtaaccggtggccgcgacaagagactttggctttgttaaggatacgctccgacatggacgtggcgtttcgagatgcaagtgttaaaggtcccttgtgggaagaagtatccaggaaaatggcagagcttgggtatcacagaagctccaagaagtgcaaagaaaaattcgagaacgtgtacaagtaccacaagagaaccaaagaaggtcgaagtgggaaacaagatggaaaaacatatcgtttctttgatcaactacaagcccttgagaaccactctccaacaccccattcccccaacccttcatcaaaaccactacaatcagcaccatcaagagtagtagcaacaacaactgcatcatcaatgtcactaccaattccaacaccaacaacaacagtgccaatgcagccaatattgtccaacactatacccacaagtagtgtccccaatatcactgttccatcaacaacaatactccctataaccatacctcaacccattctcaccaccccatcaataaacctcacaatcccttcttaccctccatcaaaccctaccaatttcccaccgccatcaaaccctaccccaccactctctttccccaccgacaccttctccaattccacctcctcctcctccacctcctccgacgaaacattggaaaggagacgcaagaggaagcgcaaatggaaggatttcttcgagagactgatgaaggaagtgatcgagaagcaagaggagctacaaaagaagttcttggaagcaatagagaaacgcgaacacgacagaatagcaagagaagaagcatggagagtacaagagatgcaaagaatcaatagagaaagagaaatcttagcacaagaaaggtccatagccgcagccaaagacgcagccgttatgtcattccttcaaaaaatagccgaacaacaaaacctcggtcaagcgttgaccaacatcaacctcgtacaaccacaaccacaactacaaccacaaccaccggtacaacaacaagtgacaccacctaatatagtaccagctcctatgcaacaaccactgcctgtgattgttacacagcctgtggtgttgccagtggtatcacaagtgaccaatatggagataatgaaagccgataataataacaacaataacaataataacaactgcgaaaatttcttgccaccgagttcttctcggtggccgaaagtggaggttcaggcattgataaagcttcgaacgagcatggatgagaagtatcaagagaatggaccaaagggtcccctctgggaggagatctcagcctcaatgaagaagctggggtacaaccgaaacgcgaaaaggtgcaaggagaaatgggagaacatcaacaagtacttcaagaaagtgaaggaaagcaacaagcggagaccggaagattccaagacgtgcccttatttccaccagctggacgcgctgtacaggcagaagcacaaagccgaagagagcaccgcggcggcgaaggcggagagcgcggtggcaccgttgatggtgcagccggagcagcaatggccacctcagcagcaggatgatagggacatcacaatggaagacatggagaacgaagatgatgaatatgaggaagagagggaaggagaggaagaagaagaagaggatgaagaggatgaagaaggtggtggtgggaactatgagatagtggcaaacaaaacaagtggcggtggtggtgctgctgcttcagtgggggcttcaacggag

SEQ ID NO: 172 - protein, 644 aa, Glycine max
  Glyma20g30640.1 (trihelix AKA GT domains 63-146,457-541)
MLGDSALLGGGGGEGGASADVVAATATHDATTTTTTGGGGGGSNNSGDDERGRIEEGERSFGGNRWPRQETLALLRIRSDMDVAFRDASVKGPLWEEVSRKMAELGYHRSSKKCKEKFENVYKYHKRTKEGRSGKQDGKTYRFFDQLQALENHSPTPHSPNPSSKPLQSAPSRVVATTTASSMSLPIPTPTTTVPMQPILSNTIPTSSVPNITVPSTTILPITIPQPILTTPSINLTIPSYPPSNPTNFPPPSNPTPPLSFPTDTFSNSTSSSSTSSDETLERRRKRKRKWKDFFERLMKEVIEKQEELQKKFLEAIEKREHDRIAREEAWRVQEMQRINREREILAQERSIAAAKDAAVMSFLQKIAEQQNLGQALTNINLVQPQPQLQPQPPVQQQVTPPNIVPAPMQQPLPVIVTQPVVLPVVSQVTNMEIMKADNNNNNNNNNNCENFLPPSSSRWPKVEVQALIKLRTSMDEKYQENGPKGPLWEEISASMKKLGYNRNAKRCKEKWENINKYFKKVKESNKRRPEDSKTCPYFHQLDALYRQKHKAEESTAAAKAESAVAPLMVQPEQQWPPQQQDDRDITMEDMENEDDEYEEEREGEEEEEEDEEDEEGGGGNYEIVANKTSGGGGAAASVGASTE

SEQ ID NO: 173 - DNA, 1962 bp, Solanum lycopersicum
  Solyc04g071360.2.1
atgctgggcgtttccggcttagtaagtagtgaaggtggtggtgataatccagaaagcggtggaggagctggaagcggagggagtagtgagattggattaggcggtggaagtggcggcggtggaggtagtagcggtggattcatgacggaagatggagaaagaaattcaggtggaaatagatggccaagacaagaaacaattgctttgctgaaaataaggtctgaaatggatgttatttttagagactcaagtcttaaaggacctttatgggaagaagtttccaggaaaatggcagaccttgggttccacagaagttccaagaaatgcaaggagaagttcgaaaatgtatacaaatatcacaagagaaccaaggatggccgagcatcgaaagcggatggaaagaattataggtttttcgagcaattggaagccctggagaacattacatctcatcattctctaatgccagtaccgtcgtctaatacgcgtcctccaccccctccgttggaagctactccaataaatatggctatgccaatggcatcatcaaatgtacaagtcacggcttcacaaggtactattcctcatcatgttactatttcatcagcaccaccgccaccgaatagcctttttgctccttctcatcaaaatgctccgtcaagttcacccgtgccactaccaccaccgccatcacagcaaccatcaccgcagccagctgtcaatccgattaataatattcctcaacaagtgaacgcttcagcaatgtcgtattcaacttcttcgtctacttcctcggatgaggatatacaaagaaggcataagaagaagaggaaatggaaggattattttgagaagttcaccaaggatgtgattaataagcaggaggaatcgcacaggaggttcttggagaagcttgagaagcgggaacatgatcggatggttcgagaagaagcatggaaagtagaggaaatggcaaggatgaatagggagcatgatcttttagttcaagaaagagcaatggcggcagccaaggatgcagctgttatttcttttttacaaaagataactgaacagcaaaacattcaaattccaaatagtatcaacgttggccctccatcagcacaagtacaaatacaattgcctgaaaacccactatccgcgcctgtaccaacacaaatacaaccgacgactgttacagcagcagcaccacctcaaccagcaccggtcccagtatcgttgccagtaacaataccagctccagtaccagcattaataccatcattgtcgctaccactgacaccaccagtgccatccaagaacatggagttagtaccaaaaagcgataacggaggtgatagttacagtccagcaagctcttcaaggtggccaaaagcagaagttgaagcattgattaaacttcgtacaaatttagatgtcaaataccaagagaacggacctaaaggtccactttgggaagagatatcatctggaatgaagaaaattggatacaatcggaatgcaaagagatgcaaagaaaaatgggaaaacatcaacaaatacttcaagaaggtgaaggagagcaacaaaaaacgacccgaagattccaaaacttgcccatatttccaccagctcgatgcactgtacaaggagaaagccaaaaaccccgaaacagcttcttcaacgtcttcgttcaatccttcattcgctttaaaccccgataacaaccaaatggctcccatcatggctcgtccagaacagcaatggccacttccacaacaccatgaaagcaccacccgtatcgaccacgaaaacgagagcgacaacatggatgaagatgatcacgatgatgaggaggatgaagatgacgaggacgaaaacaacgcttatgagatagtagcaaacaagcaacaatcctcaatggcggccgcaaacaccactaccagcaccgcaacaacaacagtt

SEQ ID NO: 174 - protein, 654 aa, Solanum lycopersicum
  Solyc04g071360.2.1 (trihelix AKA GT domains 58-141,459-543)
MLGVSGLVSSEGGGDNPESGGGAGSGGSSEIGLGGGSGGGGGSSGGFMTEDGERNSGGNRWPRQETIALLKIRSEMDVIFRDSSLKGPLWEEVSRKMADLGFHRSSKKCKEKFENVYKYHKRTKDGRASKADGKNYRFFEQLEALENITSHHSLMPVPSSNTRPPPPPLEATPINMAMPMASSNVQVTASQGTIPHHVTISSAPPPPNSLFAPSHQNAPSSSPVPLPPPPSQQPSPQPAVNPINNIPQQVNASAMSYSTSSSTSSDEDIQRRHKKKRKWKDYFEKFTKDVINKQEESHRRFLEKLEKREHDRMVREEAWKVEEMARMNREHDLLVQERAMAAAKDAAVISFLQKITEQQNIQIPNSINVGPPSAQVQIQLPENPLSAPVPTQIQPTTVTAAAPPQPAPVPVSLPVTIPAPVPALIPSLSLPLTPPVPSKNMELVPKSDNGGDSYSPASSSRWPKAEVEALIKLRTNLDVKYQENGPKGPLWEEISSGMKKIGYNRNAKRCKEKWENINKYFKKVKESNKKRPEDSKTCPYFHQLDALYKEKAKNPETASSTSSFNPSFALNPDNNQMAPIMARPEQQWPLPQHHESTTRIDHENESDNMDEDDHDDEEDEDDEDENNAYEIVANKQQSSMAAANTTTSTATTTV

SEQ ID NO: 175 - DNA, 1953 bp, Solanum lycopersicum
  Solyc12g056510.1.1
atgcttggtgtttcttcaagtttaatagctagcagtaatactagtattactgctggtgctgcaggtgatggagctgccatttcggcagctccatcacagttagcaccgccaccacaagaagctccggagagtggtgggagtagtgaaggtggtggcggtggaggagatttgtcgattggcggtgaagatggagaaaggaactcaggtggaaatcgatggccaaggcaagaaactttagctttactgaaaattagatcggaaatggatgttgttttcaaagattcaagtcttaaaggaccgttatgggaagaagtttccagaaaactcgcggagttgggttatcatcgaagtgctaagaaatgtaaagagaaattcgagaatgtttacaagtatcacaggagaaccaaagatggtcgtgcttcgaaagcagatggaaaaacttatcgattctttgatcagttacaggctttggaaaacaatccatcttctcattctaacataccgccacctccattagcagcaacacccataacaatggcaatgccaatgcgatcaggaaacaattcagcaaatcctccaatgccgacgccaacgccaactccacaaaatcataatcatttttttagtgtttcgcagaaaagtgttgtgacaggagcagcgcagcctgctgttatgactgcacctgcgctgccactgtcacaagtgccgataggtaataataacttgaaccagatgcatcggcctcaaggtaatactactactacaaaaacaagtttcctgtcgaattcaacttcatcatcatcttcaacttcgtcggatgaggatatacaaaggaggcagatgaagaagcggaaatggaaggaattctttgagagtttaatgaaggatgtgattgagaagcaagaggaattgcagaagaagtttttggaaacgctcgagaagcgcgagagggataggttgatgagagaggaggcatggagagtgcaagagatggctagattgaatagggaacatgatcttttagtccaagagagatcaatggcagcagctaaagacgcaacaatcatcgccttcttgcaaaaaataactgaacagcaaaacacacaaaccccgaatagtacaaataacacttctccttctccttttccaattgctcaaattcaattaaaattgtccgaaaagccattcagtacaccaccacaaccacaaccacaaccatcagctaccgcggtatcactgccaatgacaatacatacaccaacaccagcaccaccacagacactgacattacctgtagtatcatcaaaatcacttgaacctccaaaatccgataatggtggtgagaatttctctccagcaagctcgtcaagatggccgaaagaagaaatcgaagcattgataagtctccgaacctgtttagatctaaaataccaagaaaatggaccgaaaggaccactgtgggaagaaatttcatctggaatgagaaagataggatacaacaggaatgcaaagagatgcaaggaaaaatgggagaacatcaacaagtacttcaagaaggtaaaagaaagcaacaaaaaaagaccagaagattccaaaacttgcccatatttccaccagctggaagcactgtacaaagaaaaagccaagctcgaacctgtaccacacaacactaccttcggattaacaccccaaaacaatcctcctcctcctcctcctcccatcatggctcaacccgagcaacaatggccaattcctcaaaatcaacttcaccagcaaaatcgtgatcatcatcacgataatgaaagcgacagcatggatcacgatttggaagaggacgaggatgaggacgaagaagatgaaggtaatggctatgaaataataatcacaaataaacaacaatcatcatcaatggcggctaccccagtaacaacaacaacttctgctgctgcagtt

SEQ ID NO: 176 - protein, 651 aa, Solanum lycopersicum
  Solyc12g056510.1.1 (trihelix AKA GT domains 70-153,455-539)
MLGVSSSLIASSNTSITAGAAGDGAAISAAPSQLAPPPQEAPESGGSSEGGGGGGDLSIGGEDGERNSGGNRWPRQETLALLKIRSEMDVVFKDSSLKGPLWEEVSRKLAELGYHRSAKKCKEKFENVYKYHRRTKDGRASKADGKTYRFFDQLQALENNPSSHSNIPPPPLAATPITMAMPMRSGNNSANPPMPTPTPTPQNHNHFFSVSQKSVVTGAAQPAVMTAPALPLSQVPIGNNNLNQMHRPQGNTTTTKTSFLSNSTSSSSSTSSDEDIQRRQMKKRKWKEFFESLMKDVIEKQEELQKKFLETLEKRERDRLMREEAWRVQEMARLNREHDLLVQERSMAAAKDATIIAFLQKITEQQNTQTPNSTNNTSPSPFPIAQIQLKLSEKPFSTPPQPQPQPSATAVSLPMTIHTPTPAPPQTLTLPVVSSKSLEPPKSDNGGENFSPASSSRWPKEEIEALISLRTCLDLKYQENGPKGPLWEEISSGMRKIGYNRNAKRCKEKWENINKYFKKVKESNKKRPEDSKTCPYFHQLEALYKEKAKLEPVPHNTTFGLTPQNNPPPPPPPIMAQPEQQWPIPQNQLHQQNRDHHHDNESDSMDHDLEEDEDEDEEDEGNGYEIIITNKQQSSSMAATPVTTTTSAAAV

SEQ ID NO: 177 - DNA, 1506 bp, Populus trichocarpa
  POPTR_0001s31660.1
atggaagcttcaacaactttcccggaaaattcaaacgccgccaccggtaaccgggatagtgatgaaggcgatgaagagatgagagtgaaagctgaagagggtgaccagcactcaacagggaacaggtggccaaagcaagagactttagcgttgttgaagataaggtctgatatggatgttgcatttaaagactctggtcttaaagctcctctatgggaagaggtttcaaagaaattgaatgagcttgggtataacagaagtgccaagaaatgcaaagagaagtttgagaatatttacaagtatcatagaagaaccaaggaaggccggtccggtaggccaaatggcaagacatataggttttttgaacaattacaagctttagataacactgaggtattactgccacctccatcgtcagataaagttcatacttctatggccgcagccttggtgaacccagtaagtttcattccaaatgctgttccatgttctatccaaagccctggtatgaattttgtcgacactacctctacttcaactgcatctacttcaagtgaagaagaggaaggaacgagaaagaagaagcagaaattaacaggtttttttgagaggttgatgaaggaagtgattgagaagcaagagaatttgcaaaataagtttctagaagcaatagagaaatgcgagcaagaaaggatagctagagaagaagcatggaagatgcaagaattggataggattaagagagaacgggagcttttagttcgagaaagagcgattgcagctgcaaaagatgcagccgtgcttgcattcttacagaagttctctgagcaaggtatctcggtgcaattgcctgacaatcctatagttccgatgaaatttcctgacaatcaaacagttccagtgccatcgtctgctccagtgcaattgcccaagaaccaagcagttccagtggagaatattgtgaagacccgtgaaaatagcagtattgagagttttgttaatattagcccatcaagatggcctaaagaagaaattgaagctttgatcgggctaagaactaagcttgaattccagtatgaagaaaatggaccaaaagggccactgtgggaggagatatcagcttcaatgaaaaagcttggttatgataggagtgcaaagagatgcaaagagaaatgggagaatatgaacaagtacttcaagagggtaaaggagagcaataaaagaagacctggggattcaaaaacttgtccttatttccaacagcttgatgctctatacagagagaagaataggagggttgatggttcgggttttgagttgaagcctgaagaacttttaatgcatatgatgggtggccaaggagatcaacaacagccggaatctgccacgacagaagacagagaaagtgaaaatgttgatcagaatcaagaaaactacagagacaaggaagacggggacggcgatcgaattgtagctaatgatccttcttcaatggaaattatggag

SEQ ID NO: 178 - protein, 502 aa, Populus trichocarpa
  POPTR_0001s31660.1 (trihelix AKA GT domains 40-123,337-421)
MEASTTFPENSNAATGNRDSDEGDEEMRVKAEEGDQHSTGNRWPKQETLALLKIRSDMDVAFKDSGLKAPLWEEVSKKLNELGYNRSAKKCKEKFENIYKYHRRTKEGRSGRPNGKTYRFFEQLQALDNTEVLLPPPSSDKVHTSMAAALVNPVSFIPNAVPCSIQSPGMNFVDTTSTSTASTSSEEEEGTRKKKQKLTGFFERLMKEVIEKQENLQNKFLEAIEKCEQERIAREEAWKMQELDRIKRERELLVRERAIAAAKDAAVLAFLQKFSEQGISVQLPDNPIVPMKFPDNQTVPVPSSAPVQLPKNQAVPVENIVKTRENSSIESFVNISPSRWPKEEIEALIGLRTKLEFQYEENGPKGPLWEEISASMKKLGYDRSAKRCKEKWENMNKYFKRVKESNKRRPGDSKTCPYFQQLDALYREKNRRVDGSGFELKPEELLMHMMGGQGDQQQPESATTEDRESENVDQNQENYRDKEDGDGDRIVANDPSSMEIME

SEQ ID NO: 179 - DNA, 1557 bp, Populus trichocarpa
  POPTR_0019s02650.1
atggaagcgtcaaccactttcctggaaaattcaagcgccgccgccggtgactgggaggacgaggaaggcgatgaggggatgagggtgcaagctgaagagggtgtgcagtgctcaacagctaacaggtggccaaagcaagagactttagctttgttggagataaggtcagatatggatgttgcatttagagactctgttgttaaagctcctctttgggaagaggtttcgaggaaattgaatgagcttgggtataacagaagtgccaagaaatgcaaagagaagtttgaaaatatttacaagtatcatagaagaaccaaaggaagtcagtccggtaggccgaatggcaagacatataggttttttgaacaattacaagctttagataagaccaatgcattagtgtcacctacatcgtcagataaagatcattgtttaatgccttcggcctcggtaatcccagtgagcttcatcccaaatgatgttccatgttctgtccagagtcctagaatgaattgcaccgacgccacctctacttcaactgcatctacttcgagtgaggaatcagaaggaacaagaaagaagaagcggagattaacagatttttttgagaggttgatgaaggaagtgatagaaaagcaagagaatttgcaaaataagtttctagaagcaatagagaaatgcgagcaagaaaggatagctagagaagaagtgtggaagatgcaagaattggataggattaagagagaacaagagcttttagttcacgaaagagcgattgcagctgcgaaagatgcagctgtgcttgctttcttacagaagttctctgagcaaggtatcccggtgcaattgcctgacaaccctacagtcccgatgaaatttcctgacaatcaaacatctccagcgctactgtccaagaaccaagcagttccagtggagaatgtagtgaagacacatgaaaatagcagtgttgagagttttgtcaacatgagctcatcaagatggcctaaagaagaaattgaatctttgatcaagatacgaacttatcttgaattccagtatcaagaaaatggaccaaaagggccgctgtgggaggagatatcaacatcaatgaaaaatctcggttatgataggagtgcaaagaggtgcaaagagaaatgggagaatatgaacaagtacttcaagagggtaaaagatagcaataaaaaaagacctggggattctaagacctgtccttattttcagcagcttgatgctctatacagagagaagactaggagggttgataatcccagttacgagttgaagcctgaagaacttttaatgcatatgatgggtggccaagaagatcaacaactgccagattctgccacaacagaagacagagaaagcgaaaatgttgatcagattcaagtagactatagaggcaaagaagatggagatggttatggaattgtagctattgatccctcttcattggaaattatggaaccttattgtcaagaaccaattaggaatacatctcatagaaagcggcatccttgcatatgtatagtgtat

SEQ ID NO: 180 - protein, 520 aa, Populus trichocarpa
  POPTR_0019s02650.1 (trihelix AKA GT domains 40-123,331-415)
MEASTTFLENSSAAAGDWEDEEGDEGMRVQAEEGVQCSTANRWPKQETLALLEIRSDMDVAFRDSVVKAPLWEEVSRKLNELGYNRSAKKCKEKFENIYKYHRRTKGSQSGRPNGKTYRFFEQLQALDKTNALVSPTSSDKDHCLMPSASVIPVSFIPNDVPCSVQSPRMNCTDATSTSTASTSSEESEGTRKKKRRLTDFFERLMKEVIEKQENLQNKFLEAIEKCEQERIAREEVWKMQELDRIKREQELLVHERAIAAAKDAAVLAFLQKFSEQGIPVQLPDNPTVPMKFPDNQTSPALLSKNQAVPVENVVKTHENSSVESFVNMSSSRWPKEEIESLIKIRTYLEFQYQENGPKGPLWEEISTSMKNLGYDRSAKRCKEKWENMNKYFKRVKDSNKKRPGDSKTCPYFQQLDALYREKTRRVDNPSYELKPEELLMHMMGGQEDQQLPDSATTEDRESENVDQIQVDYRGKEDGDGYGIVAIDPSSLEIMEPYCQEPIRNTSHRKRHPCICIVYM

SEQ ID NO: 181 - DNA, 1485 bp, Solanum lycopersicum
  Solyc11g005380.1.1
atgctagaaagttctgttttgttggagaatacagctgctggtggcgccgtcaccggcgccgatggtgaagcgtcggagctgaagaatgaaggtggtggtggtggtggaagtgtcggtggaggttcagaggaagaagataagaatttttcaggtggaaatcgttggccacatgaagaaactttggctttactcaaaataagatcggaaatggatgttgcatttcgtgattccaatctcaaaagccctctctgggatgaaatttctaggaagatggctgagcttgggtataatcgaaatgcgaagaaatgcagggagaagtttgagaacatttataagtatcataagagaactaaagatggtagatctggtagacaaactgggaaaaactatcgatttttcgagcaattagagcttttagatagccaatccttgttttcatcgcctccattaaaccatagccaaatcaatagaatggaaacaatgcctgtaccaatgcctatgccaatgacaatgataaaaccagctgctagtggatgtcaggattttggaatggatcatagtcgagttcggggttttaatccggggttcatgtccacatccacgtccacgacctcgtcctcggggaaagaatccgatggtagtgtgaagaagaaaaggaaattggctagttattttgagaggttgatgaaggaagtgttggataagcaagaggacttgcaaaacaagtttctagaagcaatggaaaaatgtgagaaggatcgaatagcgagggacgaggcttggaagatgcaggaaatcgcgagattaaagaaagaacaagaagcattagctcacgaaagagcaatttctgccgcgaaagacgcagcagtgattgctttcttgcagaaagtctcagatcaaaccattcaactacagttaccaacagatttaccccataggcataccgaggaacgagagagtgaatcaatgaaaactattggaaatcaggagaatgttgttatgcaacaagacaacgacaaggaaaacattgacaaacaagagattgatagtgctggtgagaattcaaactcgtttcaaacgaattcatcttctcgatggcctaaagccgaagtggaagccttaatcaagctaagaacaaacgtcgacttgcaataccaagacaacggctcatcaaaagggcctctttgggaagacatctcatgtggtatgaagaagcttggatacgatagaaacgcgaagagatgtaaagagaaatgggagaacataaacaagtactatagaagagttaaagaaagccaaaagaaaaggccagaagattcaaaaacatgtccatattttcatcaattggattccatctatcaaaacaagtccaagaaacaattgcccattatggaaactccgggttcgaatatgaaggccggagagatactaatgcaaataatcaaccaacaacagcaacaacaagcattagaaagaacagaatgt

SEQ ID NO: 182 - protein, 495 aa, Solanum lycopersicum
  Solyc11g005380.1.1 (trihelix AKA GT domains 52-135,363-448)
MLESSVLLENTAAGGAVTGADGEASELKNEGGGGGGSVGGGSEEEDKNFSGGNRWPHEETLALLKIRSEMDVAFRDSNLKSPLWDEISRKMAELGYNRNAKKCREKFENIYKYHKRTKDGRSGRQTGKNYRFFEQLELLDSQSLFSSPPLNHSQINRMETMPVPMPMPMTMIKPAASGCQDFGMDHSRVRGFNPGFMSTSTSTTSSSGKESDGSVKKKRKLASYFERLMKEVLDKQEDLQNKFLEAMEKCEKDRIARDEAWKMQEIARLKKEQEALAHERAISAAKDAAVIAFLQKVSDQTIQLQLPTDLPHRHTEERESESMKTIGNQENVVMQQDNDKENIDKQEIDSAGENSNSFQTNSSSRWPKAEVEALIKLRTNVDLQYQDNGSSKGPLWEDISCGMKKLGYDRNAKRCKEKWENINKYYRRVKESQKKRPEDSKTCPYFHQLDSIYQNKSKKQLPIMETPGSNMKAGEILMQIINQQQQQQALERTEC

SEQ ID NO: 183 - DNA, 1782 bp, Glycine max
  Glyma16g28240.1
atgcagctaggagactcaagtgtgttggagatctcctcccatacccagcccgagatggcggtgacggcagtagtctcgccaccagaagaagtagctcatgatggcagcgacaacagtgatgattgggatggacttggatgcaaattcagctttggagggaaccggtggccccgccaagaaactttggctctcttgaagataaggtcggatatggatacagtttttcgagattcaagtcttaaaggtccactttgggaagaagtttcaaggaaattggcagaacttggatatcaaagaagcgcaaagaagtgcaaggaaaaatttgagaacgtgtacaagtacaacaagagaaccaaagacaacaaaagtggcaaatcacatggaaaaacctataaattctttgatcaattacaagcccttgagaaccaattcacaacagtctcttacccgccaaaaccacaacctacttctactttggcaacaacaaacccattgacattgccaacaaggccaagtgatcatggtaacaaagttatctcttatgtcacaacttttccttccacaaaccctactctcatttcaccttctccacaaaccaacactaccaccaccaccaccacaacaacatccacaaccaaccctagagattcatcacgaccacaaaccaacaacaacaataatagtgtcacacactctttgccaaacatgaacacctctttctctaccaccactgcctccacctcatcctccacagcgtcagatgaagacttggaagagaggtataggaggaagagaaagtggaaggactacttcaggaggctcactaggaaggtcttgttgaagcaagaggagatgcaaaagaagttcttggaagccatggaccaaagggagagggaaagggtggcacaacaagacaattggaggatgcaagaaatggcaaggatcaatagggagcatgagattcttgttcaagagagatcaacagcagcagccaaagatgctacagtcattgcattattgcaaaagatgtatggccaacaaaaccccacaccacaagttgaagtagagccaccaccacaacagaagcaaacaattccccaatcgcagcctccaatattaatgccaaacaataatttcgaggtcaagaaaataaataatggtcacagtgttactagtactactactggtactgttgctactgctactactactacttcgccggtgaattcttcttcttctcggtggccgaaggcggaagttcatgctttgataaggataaggacaagtctagaaaccaagtatcaagagaatggaccaaaagctccattgtgggaagatatctcaattgcaatgcaaaggcttgggtacaaccggagtgcaaagagatgcaaggaaaaatgggagaacatcaacaagtacttcaagagagtgagggagagtagcaaagaaaggcgtgaagatagcaagacatgtccctatttccacgagcttgaagctctatacaaagaaaagagcaaatcatccaagaacccctttggcatcttccagaatatgaagcctaatgagatgatgctgatgatgacggagccactgatggtgcaaccggagcaacaatggaggcccccacctcaatcattggaagagggtgtagggatggagaatgcaagtgaagaatatcatgaaaatgaagaaaatggtggtgatgatgatgataacattgaagaagatggagatagtgtggaagatgaaggagcaaacccgtgtgagattgcgacaaataat

SEQ ID NO: 184 - protein, 594 aa, Glycine max
  Glyma16g28240.1 (trihelix AKA GT domains 53-136,412-496)
MQLGDSSVLEISSHTQPEMAVTAVVSPPEEVAHDGSDNSDDWDGLGCKFSFGGNRWPRQETLALLKIRSDMDTVFRDSSLKGPLWEEVSRKLAELGYQRSAKKCKEKFENVYKYNKRTKDNKSGKSHGKTYKFFDQLQALENQFTTVSYPPKPQPTSTLATTNPLTLPTRPSDHGNKVISYVTTFPSTNPTLISPSPQTNTTTTTTTTTSTTNPRDSSRPQTNNNNNSVTHSLPNMNTSFSTTTASTSSSTASDEDLEERYRRKRKWKDYFRRLTRKVLLKQEEMQKKFLEAMDQRERERVAQQDNWRMQEMARINREHEILVQERSTAAAKDATVIALLQKMYGQQNPTPQVEVEPPPQQKQTIPQSQPPILMPNNNFEVKKINNGHSVTSTTTGTVATATTTTSPVNSSSSRWPKAEVHALIRIRTSLETKYQENGPKAPLWEDISIAMQRLGYNRSAKRCKEKWENINKYFKRVRESSKERREDSKTCPYFHELEALYKEKSKSSKNPFGIFQNMKPNEMMLMMTEPLMVQPEQQWRPPPQSLEEGVGMENASEEYHENEENGGDDDDNIEEDGDSVEDEGANPCEIATNN

SEQ ID NO: 185 - DNA, 1890 bp, Glycine max
  Glyma20g30650.1
atggagctaattggagacactaccacagtcatggaaacgtcgtccggtgaggctgtggcggcgcatgacggtggcgaggtgattatgatggatgcaaattccggtgaagaagagaataataataagggagaagaaggagaagaagaagaagaaggtgacaataagatcaacagtaacaacaactcattatgcggtggaaacagatggccccgccaagaaactttggctctcttgaagataaggtccgatatggatgctgtgtttcgagattcaagtcttaagggtccactctgggaagaagttgcaaggaaactatcagaactgggttaccaccgaagcgcaaagaagtgcaaggagaaattcgagaatgtatacaagtaccacaaaagaaccaaagagagcagaagtgggaaacacgagggaaaaacctacaagttttttgatcaattacaagccctcgagaaccaattcacagtctcttactctccaaaaccacaacccactttggcaacaacaacaaacataataacattaccacccccaacaaggcctagtgacacaacagcaatctcttatgtcaccaccactgttccatccacaaaccctacaatcatatcaccttcaccacaaccaccaacccatgccaccaccacaactaccatcacttctccaacagtagcaaccaaccctaaaaaccctccacaatccaacaacaacagcaacatccccaattactctttgctcaacatgaacaacctcttctccaccacttcaacctcttcgtccacggcctcggatgaggacttggaagagaagtaccgtaagaagagaaagtggaaggactacttcaggaggctcacgaggcaagtcttggccaagcaagaggaaatgcagaagaggttcctcgaagccattgacaatagggagagagaacaagtggcgcaacaagaggcttggaggatccaagaaatggcaaggatcaatagagaacacgaacttcttgtccaagaaagatcaaccgcagcagcaaaaaatgcagcagttattgcttttttgcaacagttatctggtcaacaccaaaattccaccacaacaaaagctggtgccaatttccttcaacaaccacttccacaacaagtacaaccaccaccacaacaagctccacaaccactgatgatgtcaaataataacaacattgaaattcagaaaatgaataatggtcacagtgttgttgctgctgctactcctactactgtcgttgctgctactgctattgctactacagctgttactactactccttcttcattgagctctttatcttcttctaggtggccaaagacagaagttcatgctttgataagattgaggacgagtcttgaagcaaagtaccaagaaaatgggccaaaggctccattctgggaggatatatcagcaggaatgctgagactagggtacaacagaagtgccaagaggtgcaaagagaaatgggagaacatcaacaagtacttcaagaaggtcaaagagagcaacaagcaaaggcgcgaggatagtaagacatgtccttattttcatgaacttgaagctctatacaaagaaaagagcaagactactcagaacccctttggcgcttcgttccacaacatgaagccacatgagatgatggagccattgatggtgcaaccggagcagcaatggagacctcccactcaatatgaacaaggtgcagccaaggagaacaataatagtgaaagaaaagaaagagaggaggaggaagaagaagaagatgatgatgaaaatgaagagggagatctagagagtgtggaagatgaaggaggtaaccgttatgagattgcgacaaataaactttcttcagtggacaccgttgaa

SEQ ID NO: 186 - protein, 630 aa, Glycine max
  Glyma20g30650.1 (trihelix AKA GT domains 66-149,442-526)
MELIGDTTTVMETSSGEAVAAHDGGEVIMMDANSGEEENNNKGEEGEEEEEGDNKINSNNNSLCGGNRWPRQETLALLKIRSDMDAVFRDSSLKGPLWEEVARKLSELGYHRSAKKCKEKFENVYKYHKRTKESRSGKHEGKTYKFFDQLQALENQFTVSYSPKPQPTLATTTNIITLPPPTRPSDTTAISYVTTTVPSTNPTIISPSPQPPTHATTTTTITSPTVATNPKNPPQSNNNSNIPNYSLLNMNNLFSTTSTSSSTASDEDLEEKYRKKRKWKDYFRRLTRQVLAKQEEMQKRFLEAIDNREREQVAQQEAWRIQEMARINREHELLVQERSTAAAKNAAVIAFLQQLSGQHQNSTTTKAGANFLQQPLPQQVQPPPQQAPQPLMMSNNNNIEIQKMNNGHSVVAAATPTTVVAATAIATTAVTTTPSSLSSLSSSRWPKTEVHALIRLRTSLEAKYQENGPKAPFWEDISAGMLRLGYNRSAKRCKEKWENINKYFKKVKESNKQRREDSKTCPYFHELEALYKEKSKTTQNPFGASFHNMKPHEMMEPLMVQPEQQWRPPTQYEQGAAKENNNSERKEREEEEEEEDDDENEEGDLESVEDEGGNRYEIATNKLSSVDTVE

SEQ ID NO: 187 - DNA, 1779 bp, Populus trichocarpa
  POPTR_0002s06900.1
atgatcggtgattcaagtgtgcaagcaacctctagtgatgttgcggccacagcgaccagggtcgccactgaaggtggtgagggtggtggtggaggtggttttggttcaaattcagctgaagaagataagactatgggggttgatcatgaaggtaaccggatgaattatggtgcaaaccggtggcctaggcaagagactttggccttactgaagataaggtccgatatggatgcagtgtttcgtgactcaggtctaaaaggtccgttatgggaagaggtttccaggaaactagcagagcttggttatcatcggagtgccaagaaatgcaaggagaaattcgagaacgtgtacaaataccacaagcgaaccaaagaaggccgaacaggtaaatccgaaggaaaatcttacaagttttttgatgaattagaagctttccaaaatcatcctccacattcaacacaaccgccaacattgacgccgccgccgctgccaccaccaaaagctcaaactgcatctgcaacaattaccacattgccatggactaataacaacaccgctatcgtctctcatgctactgttccatcaagaacaaaccctatggatatcatgtcacaaagcattgctacaccaaccaacaaccgtgcaattagtccgatgccaatatcttcaaatcccataaatccttctcaaaatgcttacccatcttctttgcaaaacctcactacacatcttttggctagttctagtccatcatcaacagcatcagatgaagagttggaagtaagttataagaagagaaagagagagagcaactggaaggacttttttgagaggctaacgagggatgtcatcaagaagcaagaggatttgcaggagaaattcttggaaacgattgagaaatacgagcatgaaagaatggcacgcgaagaggcatggagaatgcaagagatggcaagaatcaatagagaacatgaaactttaatccaagaacgatccacggcagcagcaaaagatgctgcagttgttgccttcttgcaaaagatatcgggacagcaaaactcagttcaaacacaagaaatcccacaaccaacaacaactccaacagcacctccatcacagccattacagcttaggccaccacccagtctcgcaccggttgcaaaattggaggttccaaaaagggataatggagataattttactgtatcaagctcttctagatggccaaaagtagaagttcaagctcttattaatctcagagccaatcttgatgttaagtatcaagaaaatggagctaaagggcctttatgggaggatatttcagctggaatgcaaaagcttggatataataggagtgcaaagagatgcaaagagaaatgggagaatataaacaagtatttcaagaaagtaaaagagagcaacaagaagaggcctgaagattcaaaaacatgtccatacttcgaccagctcgatgctctatacaaggagaaaaataaaatggaaattacagtcaactcagattatgctgtcaagccaactagcacaatggagccactaatggtacgaccagaacaacaatggccttttcaacaagcaacccagcctcagacaatcattgaagataacgaaagaaatattaacatcgatcacaatattgaagatgatgatgatgatgatgttgttgttgatgatgatgatgtagatactgatgaagaggatgagggaggtggctttgaggtagtagcaaacaaatcagctcccttggtcaatggtgatcag

SEQ ID NO: 188 - protein, 593 aa, Populus trichocarpa
  POPTR_0002s06900.1 (trihelix AKA GT domains 58-141,405-489)
MIGDSSVQATSSDVAATATRVATEGGEGGGGGGFGSNSAEEDKTMGVDHEGNRMNYGANRWPRQETLALLKIRSDMDAVFRDSGLKGPLWEEVSRKLAELGYHRSAKKCKEKFENVYKYHKRTKEGRTGKSEGKSYKFFDELEAFQNHPPHSTQPPTLTPPPLPPPKAQTASATITTLPWTNNNTAIVSHATVPSRTNPMDIMSQSIATPTNNRAISPMPISSNPINPSQNAYPSSLQNLTTHLLASSSPSSTASDEELEVSYKKRKRESNWKDFFERLTRDVIKKQEDLQEKFLETIEKYEHERMAREEAWRMQEMARINREHETLIQERSTAAAKDAAVVAFLQKISGQQNSVQTQEIPQPTTTPTAPPSQPLQLRPPPSLAPVAKLEVPKRDNGDNFTVSSSSRWPKVEVQALINLRANLDVKYQENGAKGPLWEDISAGMQKLGYNRSAKRCKEKWENINKYFKKVKESNKKRPEDSKTCPYFDQLDALYKEKNKMEITVNSDYAVKPTSTMEPLMVRPEQQWPFQQATQPQTIIEDNERNINIDHNIEDDDDDDVVVDDDDVDTDEEDEGGGFEVVANKSAPLVNGDQ

SEQ ID NO: 189 - DNA, 1761 bp, Populus trichocarpa
  POPTR_0005s21420.1
atgctaggtgattcaagtgtgctagcaagctctagtgatgttgcgaccaccgcgactagggtcgtccctgaaggtggtgaagtttgcgaagttggcgatgcaggtggttttggttcaaattcaaccgaagaagataagaatatgggcggtgatcatgaaggtgaccggatgaattatggtgcaaaccggtggcctagacaagagactttggccttactgaagataaggtccgctatggatgcagtgtttcgggactcaagtctaaaaggtccattatgggaagaggtttccaggaaactagctgagcttggttatcatcggagtgccaagaaatgcaaggagaaattcgagaacttatacaaataccacaagcgaaccaaagaaggccgaactggtaaatccgaaggcaaaacttacaagttttttgatgaattagaagcttttcaaaatcaccattcacattcagcacaaccgccaacaatattggcaccgccgctgccaccaccaaaagctcaaactccaaccgcaacaactgccacattgccgtggactaatagtcctgctatcgtctctcatgttactgttcaatcgacaacaaaccctatcgatatcttgtctcaaggcattgctacaccaacaaccatccacagtacaattagtccgatgcctttatcttcaaattccctgaatccttctcaagatactttaccatcttctttacaaaaccttgctacacatcttttttctagttctacttcatcatcaacagcatcagatgaaaaattggaaggaagtaggaaaagaaagagaaagagaaattggaaggactttttcctgaggctaacgagagatgtcatcaagaagcaagaggatttgcagaagaagtttttggaaacggtagagaaatgcgagcatgaaagaatggcacgcgaagatgcttggagaatgaaagagatggcaagaatgaatagacaacatgaaattttaatccaagaacgatccacggcggcagcaaaagatgctgcagtttttgcattcctgcaaaagatatcgggacagcaaaactcaacggaaacacaagcaattccacaacccaaactaacgccacctccaacacagccacctcagcctaggccaccacccaccagtctggaaccggttacaaacttggtggtttcaaaatgggataatggagagaatgttactgtatccagctcttctagatggccaaaagtggaagttcaagctcttattagtcttagagccgatcttgatattaagtatcaagagcatggagctaaagggcctttatgggaggatatctcagctggaatgcaaaagcttggatataataggagtgcaaagagatgcaaagagaaatgggagaatataaacaagtatttcaagaaagtaaaagagagcaacaggaagaggcctggagattcaaaaacttgtccatacttcgaccagctcgatgctctatacaaggagaaaaataaaatggagagcagagtcagcacaggttatgctgtcaagcccattagcacgatggagccattaatggtaagcccggaacaacaatgcccttttgaacaagcaaaccagcctgagacaatcattgaagataacgaaagagatattaacatcgatcacaatatcgaagaagatgatgatgatatggatgatgatactgaggaagaagatgagggagttggttttgaagtagtagcaaacagaccagcttcattgaccaatggtgag

SEQ ID NO: 190 - protein, 587 aa, Populus trichocarpa
  POPTR_0005s21420.1 (trihelix AKA GT domains 61-144,406-490)
MLGDSSVLASSSDVATTATRVVPEGGEVCEVGDAGGFGSNSTEEDKNMGGDHEGDRMNYGANRWPRQETLALLKIRSAMDAVFRDSSLKGPLWEEVSRKLAELGYHRSAKKCKEKFENLYKYHKRTKEGRTGKSEGKTYKFFDELEAFQNHHSHSAQPPTILAPPLPPPKAQTPTATTATLPWTNSPAIVSHVTVQSTTNPIDILSQGIATPTTIHSTISPMPLSSNSLNPSQDTLPSSLQNLATHLFSSSTSSSTASDEKLEGSRKRKRKRNWKDFFLRLTRDVIKKQEDLQKKFLETVEKCEHERMAREDAWRMKEMARMNRQHEILIQERSTAAAKDAAVFAFLQKISGQQNSTETQAIPQPKLTPPPTQPPQPRPPPTSLEPVTNLVVSKWDNGENVTVSSSSRWPKVEVQALISLRADLDIKYQEHGAKGPLWEDISAGMQKLGYNRSAKRCKEKWENINKYFKKVKESNRKRPGDSKTCPYFDQLDALYKEKNKMESRVSTGYAVKPISTMEPLMVSPEQQCPFEQANQPETIIEDNERDINIDHNIEEDDDDMDDDTEEEDEGVGFEVVANRPASLTNGE

SEQ ID NO: 191 - DNA, 1117 bp, Arabidopsis thaliana
  AT2G40350 (G1755)
ctaggagaacatattcatcaatacaatcctctagtctgacctgaccaaaaccagatcttgcatttgtatcctcacgtgcacaaacttcagattcatcagaaaatgcagtaaccgagcctgacacagtggcagcagtggaagattgagtcgggcagactgaccgtaaatagctttggaagcctcatcataagccaatgcagcttcatatgaactagagaaagtaccgagccataacttagcacctcggcctggctcacggatctcagcaacccatttaccccatgtcctctgtctaactcctgtatagtcacaaatcccattttcaggtccacctttacctttcatacaacccttcctcgaacgttttggaggagcctttcggattggttttgaaccaccaccatcgatgcaagaatctgcctcggtctgctcattgtactctctccatttccttagaatctcagctacatctcgtgttccacgagacttccgtttcctgggcatagaagcaagattagcaacatgctcgtgaactattgggcacagaagcaagtcccattttttctcttaacaagatttaaagcaacatgttcaactatacttgggatcaaagcaccttcaaagaaacaatttttaagcatcacagaatctaccaacaccgaagtagctacaagaatttttcacaatctgcagcatcacagcgaataaaaagaaaccccatcacgaccacaattagaacagagcaaactcaggaaaggtaccacatttaacgtttattccagctaaagatcctctaatttccaagtctcttaaccccacacgaactcgaagccacaaatcgcacagaacgtaatccaaaagagacaaattgtgcccaaaattaacaaatttctgtctacgaaaaaccccaaaaaccctaaagtgaaaaccttctagctttcaactactaaacaaacaaaagaagttactttaaggaacttgataccactcaaaaacaacaacaatcctgtaaaaacaaaatctttaacaatgaacaattagcacacatacacaagcgggaaaacaaaaacaaaaaaaacggacaaacaaacctgtcaacaatctccgacgctgacgg

SEQ ID NO: 192 - protein, 164 aa, Arabidopsis thaliana
  AT2G40350 (G1755, AP2 domain 72-129)
MPSASEIVDRKRKSRGTRDVAEILRKWREYNEQTEADSCIDGGGSKPIRKAPPKRSRKGCMKGKGGPENGICDYTGVRQRTWGKWVAEIREPGRGAKLWLGTFSSSYEAALAYDEASKAIYGQSARLNLPLLPLCQARLLHFLMNLKFVHVRIQMQDLVLVRSD

SEQ ID NO: 193 - DNA, 837 bp, Brachypodium distachyon
  Bradi2g04000.1
atggagcggggcgagggcaagcggggagccggagactgctccgtgcaggagaggaagaagaaagtgcgcaggagaagcactggccctgattcgattgctgaaaccatcaagaaatggaaggagcaaaatcagaagctccagggagagaatggaccccggaaagcgccggccaagggttccaagaaagggtgcatggcagggaagggaggtccagaaaattcaaattgtgcttaccgcggtgtgaggcagcggacgtggggcaaatgggtcgctgagatccgcgagcccaaccgcggcaagcggctatggcttggctcattccctactgcggtggaagctgcgcatgcatatgacgaggcggcaagggcaatgtatggcgccaaagcacgtgtcaacttctcagagcattccacggatgccaactctggttgcacctcagcaccttcattgctgatgtctaatgggccaaccactgcgtcacatccatctgatgagaaggatgagttggaatctcctccatttgtgatgtccagtgcgccgactgatgggctgcatcagcctgatgcgaaggatgagtatggatctgcagggacactggtgcacgaggtgaaaacggaagtgagcaatgacttgagaagtacctgtgaggagcacaagaccgcggaagtattccaacaggagggcaatgctttacacaaagaagtgaaagtaagttatgattacttcaacgtcgaagaagttctcgacatgataatcgtggaattgagtgctgatagaaaaatggaagtacatgaagagtaccaagatggcgatgatgggtttagtctgttctcatat

SEQ ID NO: 194 - protein, 279 aa, Brachypodium distachyon
  Bradi2g04000.1 (AP2 domain 76-133)
MERGEGKRGAGDCSVQERKKKVRRRSTGPDSIAETIKKWKEQNQKLQGENGPRKAPAKGSKKGCMAGKGGPENSNCAYRGVRQRTWGKWVAEIREPNRGKRLWLGSFPTAVEAAHAYDEAARAMYGAKARVNFSEHSTDANSGCTSAPSLLMSNGPTTASHPSDEKDELESPPFVMSSAPTDGLHQPDAKDEYGSAGTLVHEVKTEVSNDLRSTCEEHKTAEVFQQEGNALHKEVKVSYDYFNVEEVLDMIIVELSADRKMEVHEEYQDGDDGFSLFSY

SEQ ID NO: 195 - DNA, 843 bp, Oryza sativa
  LOC_Os01g07120.1
atgctgtttcgatttgtgtcttgcaatgttcagctttgtggaattattgagttacctcattgggtcaggaagaagagaacgcgaaggaaaagcgatggccctgattcaatcgctgaaaccatcaagtggtggaaggagcaaaaccagaagctccaggaggagaatagctccaggaaagcgccagccaaggggtccaagaaagggtgcatggctgggaaaggaggtccggaaaattcaaattgtgcttaccgcggtgtcaggcaacggacatggggtaagtgggtggctgagatccgtgaaccaaaccgtggaaggcgcctatggctaggatcatttcctactgcgctggaggctgcgcatgcatacgatgaggcggcaagggcaatgtatggtcccacagcacgtgtcaattttgcagataattccacagatgccaactctggctgcacatcagcaccttcattgatgatgtctaatgggccggccactataccttctgatgagaaggatgagctggaatctcctcctttcatcgtggctaatgggccagctgtgttgtatcagcctgataagaaggatgtgttggaacgtgtagtccctgaggtgcaggatgttaaaacagaagggagcaatggcttgaaacgtgtttgtcaggagcggaagaatatggaggtatgtgaatcagaagggatcgttttacacaaagaagtgaacataagttatgattatttcaatgtccatgaagttgttgagatgataattgttgaattaagtgctgatcagaaaacggaagtacatgaagagtaccaagagggagatgatgggtttagccttttctcctat

SEQ ID NO: 196 - protein, 281 aa, Oryza sativa
  LOC_Os01g07120.1 (AP2 domain 81-138)
MLFRFVSCNVQLCGIIELPHWVRKKRTRRKSDGPDSIAETIKWWKEQNQKLQEENSSRKAPAKGSKKGCMAGKGGPENSNCAYRGVRQRTWGKWVAEIREPNRGRRLWLGSFPTALEAAHAYDEAARAMYGPTARVNFADNSTDANSGCTSAPSLMMSNGPATIPSDEKDELESPPFIVANGPAVLYQPDKKDVLERVVPEVQDVKTEGSNGLKRVCQERKNMEVCESEGIVLHKEVNISYDYFNVHEVVEMIIVELSADQKTEVHEEYQEGDDGFSLFSY

SEQ ID NO: 197 - DNA, 1038 bp, Setaria italica
  Si002067m
atgcgtaggctcgcagggcggcgggcgggcggatgcgtgacgctggtgggtggaattggaaacgcttgtgttgaccacgcccccgcccccccgcccaccgccagccgccaggttagccgcaccgcgagctggcgtccacgtcaaaaccgaagcggcggcagcgtcagaggaaggcctgccgctgcgcttgcggccggaggaaatctagggaggaggaggaggaggagggtgggagggggagatctcccttctctctcttccatggacctgggacacggcgcccagggaggggaaggggactcctccggctccggggggcaactcaggaagaagaggatgaggaggaaaagcactggccctgactccattgctgagacaatcaagtggtggaaggagcagaaccagaagctccaggatgagagtggctccaggaaagcgcccgccaagggttccaagaaagggtgcatggcgggtaaaggaggtcctgagaatgggaattgtccgtaccgcggcgtgaggcaacggacttggggcaaatgggtggccgagatccgcgagcccaaccgtggcaagcggctgtggctaggctcattccctactgctgtggaggctgctcatgcatacgacgaggcggcaaaggcgatgtatggtcccaaggcacgtgtcaactttcccgagaactctgctgatgccaactctggttgcacgtcagcactttctttgctggcgtctagtgtaccagctgctgcattgcacgggtttaatgagaaggatgaggtggaatctgtggagactgaggtgcatgaggtgaaggcagaagcgaacgatgacttgggaagtatccacgtggagtgcaagtccgtggaggtacttcagtctgaggagattgttttacagaaagaagggaacgtaagttatgactacttcaacgtcgaagaagttgttgagatgataattatagaattgaatgcagataaaaaaattgaagtacatgaagaatgtcttggtggagatgatggatttagtctttttgcatat

SEQ ID NO: 198 - protein, 346 aa, Setaria italica
  Si002067m (AP2 domain 167-224)
MRRLAGRRAGGCVTLVGGIGNACVDHAPAPPPTASRQVSRTASWRPRQNRSGGSVRGRPAAALAAGGNLGRRRRRRVGGGDLPSLSSMDLGHGAQGGEGDSSGSGGQLRKKRMRRKSTGPDSIAETIKWWKEQNQKLQDESGSRKAPAKGSKKGCMAGKGGPENGNCPYRGVRQRTWGKWVAEIREPNRGKRLWLGSFPTAVEAAHAYDEAAKAMYGPKARVNFPENSADANSGCTSALSLLASSVPAAALHGFNEKDEVESVETEVHEVKAEANDDLGSIHVECKSVEVLQSEEIVLQKEGNVSYDYFNVEEVVEMIIIELNADKKIEVHEECLGGDDGFSLFAY

SEQ ID NO: 199 - DNA, 1143 bp, Brachypodium distachyon
  Bradi2g29960.1
atgactgtagaccagagatccgtcgcggcggcgccgttggagatcccggcgcttcagccaggaagaacacttggagcagaggcaaatacccggagtcatgtttccgtcgaatcaataggaagctgtactcttccctgtaatgagtgcgaactctcggcccagcaaacccccaaaggagttgcgccagtggcgtctattctgcggaaaaagcgaccccgtagatcacgcgacgggcctaattcagtctctgagacgatcaggcggtggaaagaagtcaaccaacagctggagcatgatccagagggtgcaaagagggcaaggaagccacctgcaaagggttcaaagaagggctgcatgcaggggaaagggggacctgagaacacgcggtgcaagttccgtggtgtaaggcaacgcacttgggggaagtgggtcgctgaaattcgggagccaaatcgggtcagcaggctctggttaggaacattccccacagctgaaactgctgcctgtgcttatgatgaggcagccagagcaatgtatggtccgctggcccgtaccaacttcaccatacaggatgtgccaactcctgctgtggatataccagcggttgttcagcgtcttctacctggtggttcaacatcatgtgagtctacaatgacatctaatcattctggcatcgtggcttcctcgcgagttctggagatttctagttcgttgaagcaatcagatgttggctccgagcatgaccaaagaagcaatcaatattcttctcctcaagctgggtcaagcgttgcaaggagcagagctgacgacctctttgagccattggagcctatagcaaatttgccagatggggaagatgatggttttgatattgaagaactgttgagaatgatggaagctgacccggtagaagctgctgaaccgatggttgagaactcgtggactgggttccaggatgtgggagcaaacactgttgtcgattttgaccaacaggagccttcatacctggatgacttcaatccaagcatgctggagggcatgctccaattggccgagccgttccccacgtgtatttctgaagatcgggtcatgttcaaccctggattgcgagatgctgatctaagcgagttctttgaagggcta

SEQ ID NO: 200 - protein, 381 aa, Brachypodium distachyon
  Bradi2g29960.1 (AP2 domain 130-187)
MTVDQRSVAAAPLEIPALQPGRTLGAEANTRSHVSVESIGSCTLPCNECELSAQQTPKGVAPVASILRKKRPRRSRDGPNSVSETIRRWKEVNQQLEHDPEGAKRARKPPAKGSKKGCMQGKGGPENTRCKFRGVRQRTWGKWVAEIREPNRVSRLWLGTFPTAETAACAYDEAARAMYGPLARTNFTIQDVPTPAVDIPAVVQRLLPGGSTSCESTMTSNHSGIVASSRVLEISSSLKQSDVGSEHDQRSNQYSSPQAGSSVARSRADDLFEPLEPIANLPDGEDDGFDIEELLRMMEADPVEAAEPMVENSWTGFQDVGANTVVDFDQQEPSYLDDFNPSMLEGMLQLAEPFPTCISEDRVMFNPGLRDADLSEFFEGL

SEQ ID NO: 201 - DNA, 999 bp, Setaria italica
  Si022619m
atgacggtggatcagaagcaggccatgccgatgcaggcgcaggccatgcagcccggaagcaggaagaagcgtcctcgcagattgcgcgatgggccaacctcagtggcagctgtcatccagcggtgggctgagcacaacaagcagttggagcacgattctgagggcgcgaagcgaccaaggaaagcacctgctaagggttcaaaaaagggctgcatgaagggaaaaggagggcctgagaatacacactgtggataccgtggagtgaggcagcgtacttggggtaagtgggttgctgaaatccgagagccgaatcgggccaacagactctggctggggaccttcccaactgcagaggatgcagccagggcctatgaccaggcggccagagcgatgtatggagaagtcgcccgcaccaacttccccagacagaatgcagtggcctctagccaagttgcttgggcggcaacccctgcccaggttgctccatcagttgttgaaggtgttgtacatagcacatcatgcgagtcaacgacaacatcaaatcactcagatattgcatccaccttgcataagccggaagtatccgacctttcaagctctgtgaaggtggagtgcccagaagttgtggaggctggttcacgtaggtctgagatggtatctggtacttcgcatcagcatgaagacagccatcccagtacccaagctagcacacccaatgtaggtgacaaggaagtcttcgagccacttgaacctattgccaaccttccagagggtgattttgatggttttgatattgatgagatgctgagaatgatggaagctgatccacagaatgaaggtggtgctggtgctggcatggagcagcccttctactttgatgggttggattcaagtttactggagagtatgctccagtcggagccagagccatattccctgtctgaggaacaggacatgttccttgctggctttgaaagtcctggtttcttcgagggcctg

SEQ ID NO: 202 - protein, 333 aa, Setaria italica
  Si022619m (AP2 domain 83-140)
MTVDQKQAMPMQAQAMQPGSRKKRPRRLRDGPTSVAAVIQRWAEHNKQLEHDSEGAKRPRKAPAKGSKKGCMKGKGGPENTHCGYRGVRQRTWGKWVAEIREPNRANRLWLGTFPTAEDAARAYDQAARAMYGEVARTNFPRQNAVASSQVAWAATPAQVAPSVVEGVVHSTSCESTTTSNHSDIASTLHKPEVSDLSSSVKVECPEVVEAGSRRSEMVSGTSHQHEDSHPSTQASTPNVGDKEVFEPLEPIANLPEGDFDGFDIDEMLRMMEADPQNEGGAGAGMEQPFYFDGLDSSLLESMLQSEPEPYSLSEEQDMFLAGFESPGFFEGL

SEQ ID NO: 203 - DNA, 996 bp, Setaria italica
  Si022621m
atgacggtggatcagaagcaggccatgccgatgcaggcgcaggccatgcagcccggaaggaagaagcgtcctcgcagattgcgcgatgggccaacctcagtggcagctgtcatccagcggtgggctgagcacaacaagcagttggagcacgattctgagggcgcgaagcgaccaaggaaagcacctgctaagggttcaaaaaagggctgcatgaagggaaaaggagggcctgagaatacacactgtggataccgtggagtgaggcagcgtacttggggtaagtgggttgctgaaatccgagagccgaatcgggccaacagactctggctggggaccttcccaactgcagaggatgcagccagggcctatgaccaggcggccagagcgatgtatggagaagtcgcccgcaccaacttccccagacagaatgcagtggcctctagccaagttgcttgggcggcaacccctgcccaggttgctccatcagttgttgaaggtgttgtacatagcacatcatgcgagtcaacgacaacatcaaatcactcagatattgcatccaccttgcataagccggaagtatccgacctttcaagctctgtgaaggtggagtgcccagaagttgtggaggctggttcacgtaggtctgagatggtatctggtacttcgcatcagcatgaagacagccatcccagtacccaagctagcacacccaatgtaggtgacaaggaagtcttcgagccacttgaacctattgccaaccttccagagggtgattttgatggttttgatattgatgagatgctgagaatgatggaagctgatccacagaatgaaggtggtgctggtgctggcatggagcagcccttctactttgatgggttggattcaagtttactggagagtatgctccagtcggagccagagccatattccctgtctgaggaacaggacatgttccttgctggctttgaaagtcctggtttcttcgagggcctg

SEQ ID NO: 204 - protein, 332 aa, Setaria italica
  Si022621m (AP2 domain 82-139)
MTVDQKQAMPMQAQAMQPGRKKRPRRLRDGPTSVAAVIQRWAEHNKQLEHDSEGAKRPRKAPAKGSKKGCMKGKGGPENTHCGYRGVRQRTWGKWVAEIREPNRANRLWLGTFPTAEDAARAYDQAARAMYGEVARTNFPRQNAVASSQVAWAATPAQVAPSVVEGVVHSTSCESTTTSNHSDIASTLHKPEVSDLSSSVKVECPEVVEAGSRRSEMVSGTSHQHEDSHPSTQASTPNVGDKEVFEPLEPIANLPEGDFDGFDIDEMLRMMEADPQNEGGAGAGMEQPFYFDGLDSSLLESMLQSEPEPYSLSEEQDMFLAGFESPGFFEGL

SEQ ID NO: 205 - DNA, 759 bp, Eucalyptus grandis
  Eucgr.G03094.1
atgtcgccggagatcgtcgaaaggaagaggtcacggagtagaaaggaaggttctatgtccgtggcagagacattggcaaaatggaaacaatacaacgaccagctcgatccgcaggccaatggagacaagcctgcgcgtagggtgcccgccaagggttcgaaaaaggggtgtatgaaaggcaaaggtggtcccgagaatacgaccttcaattacagaggagtgaggcagaggacttggggcaaatgggttgctgaaatccgagagccgaaccgagggagtaggttgtggctgggcacgttcccgactgcaatcgaagctgctaaggcttatgatgaagctgcgaccgcaatgtacggtccatgtgcgaggttgaatttccccaccgcgtctcatcccatgtctttcggtgacttggatgccagagccacaacaccggtgggcactactgctaacacgactggtaccccaagcactggttattctgctggtaccccgagcactggttattcggcgggcaccccaagcgaggccacgacattgtccagtcagtcagaattgactggtggcccagaggttaaggacggggatcgcaagggtgagtcgaatgcagatggtggagagatggagccgaagagcgaatccattgttgacttcgactggctgagtgactatgccgtggatgacctgttcgatgtggacgaattgttaaggactttggagtctgatccgaagttctcctcagatgtcaagatggagcat

SEQ ID NO: 206 - protein, 253 aa, Eucalyptus grandis
  Eucgr.G03094.1 (AP2 domain 69-126)
MSPEIVERKRSRSRKEGSMSVAETLAKWKQYNDQLDPQANGDKPARRVPAKGSKKGCMKGKGGPENTTFNYRGVRQRTWGKWVAEIREPNRGSRLWLGTFPTAIEAAKAYDEAATAMYGPCARLNFPTASHPMSFGDLDARATTPVGTTANTTGTPSTGYSAGTPSTGYSAGTPSEATTLSSQSELTGGPEVKDGDRKGESNADGGEMEPKSESIVDFDWLSDYAVDDLFDVDELLRTLESDPKFSSDVKMEH

SEQ ID NO: 207 - DNA, 642 bp, Glycine max
  Glyma06g45680.1
atgcacatgttagtgaaaaaccacaataagggggatggatctaagtccctcgccgatacactggcgaaatggaaagaatataatgcttggctggagtctaacaatgaagctgagaagccggctaggaaggtccctgccaagggatcaaagaaagggtgtatgaaaggaaaaggagggcccgagaactcacgctgtaactacagaggagttaggcaaaggacttggggaaaatgggttgctgaaatccgagagccaaacagaggaagtaggctctggttgggtacttttcccactgccattagcgctgctctcgcttatgatgaagcagcaagggcaatgtatggttcctgtgcgcgcctcaactttcccaacgttcaagtttcaactttgtctgaggaatcgtcgagaaattctccagctgctgctaaccggtcgagaaattctccagctgctagtcaatccggtcatgcgttgatgatattagagagttctgagtgcatgatattgccgaacaactctggtggagacgcagcagaggatgatgacatggaagacctttccttatccttaagtgtgaaacgtgtgaagcacgaggaaggggaggatgaatcagggaccagttcttcctatctttcattgtct

SEQ ID NO: 208 - protein, 214 aa, Glycine max
  Glyma06g45680.1 (AP2 domain 65-122)
MHMLVKNHNKGDGSKSLADTLAKWKEYNAWLESNNEAEKPARKVPAKGSKKGCMKGKGGPENSRCNYRGVRQRTWGKWVAEIREPNRGSRLWLGTFPTAISAALAYDEAARAMYGSCARLNFPNVQVSTLSEESSRNSPAAANRSRNSPAASQSGHALMILESSECMILPNNSGGDAAEDDDMEDLSLSLSVKRVKHEEGEDESGTSSSYLSLS

SEQ ID NO: 209 - DNA, 633 bp, Glycine max
  Glyma12g11150.1
atgcacatgttagtgaaaaaccacaataagggggatggatctaagtccctggccgatacactggcgaaatggaaagaatataatgcctggctggagtctaacaatgaagctgagaagccggttaggaaggtccctgccaagggatcaaagaaaggatgtatgaaaggcaaaggaggacctgagaacttgcgctgtaattacagaggagttaggcaaaggacatggggaaaatgggttgctgaaatccgagagccaaacagaggaagtaggctctggttgggtacttttcccactgccattagcgctgctcttgcttatgatgaagcagcgatggcaatgtatggtttctgtgcacgcctcaactttcccaatgttcaagtttcaactttttccgaggaaccgtctagaaattctccagctgctgcttaccagtcaagaaattctccatctgctaaagaatccggttctgcgttggtgatattagagaggtctgagtgcatgatgttgtggaacaattctggtggagatgcagcagaggatgatggcatggaagacctttccttatccttaagtgtgaaacatgaggaaggggaggatgaatcagggaccagttcttcctatctttcattgtct

SEQ ID NO: 210 - protein, 211 aa, Glycine max
  Glyma12g11150.1 (AP2 domain 65-122)
MHMLVKNHNKGDGSKSLADTLAKWKEYNAWLESNNEAEKPVRKVPAKGSKKGCMKGKGGPENLRCNYRGVRQRTWGKWVAEIREPNRGSRLWLGTFPTAISAALAYDEAAMAMYGFCARLNFPNVQVSTFSEEPSRNSPAAAYQSRNSPSAKESGSALVILERSECMMLWNNSGGDAAEDDGMEDLSLSLSVKHEEGEDESGTSSSYLSLS

SEQ ID NO: 211 - DNA, 591 bp, Glycine max
  Glyma12g32400.1
atgttagcgaaaacccataacaaaggggatggatctaagtccctggctaagatactggcaaaatggaaagaatataatgcccagattgattccagcagtgatgcggataagccagttcgcaaagttcctgccaagggatcgaagaaggggtgcatgaaaggtaaagggggccctgagaactcgcggtgtaactacagaggtgttaggcaaaggacttggggaaagtgggttgctgaaatccgagagccaaacagaggcaataggctttggctaggtactttccccactgccattggagctgcccttgcatatgatgaagcggccagggcaatgtacggttcctgtgcccgtctcaactttcccaatgtttcagtttccagtttctctgaagaatcttccaaagattctccggttgcgaatcattgtggttcgtcaatggcagtgtctgcaaacgagtccatgatttcaccaagtaactcgggggtaggtgcagaagatgatgttgatatggagcccatttccttatccttaactgtaaagcatgagaatggggaaggtgaatcggggataagttcttcccctccttcccca

SEQ ID NO: 212 - protein, 197 aa, Glycine max
  Glyma12g32400.1 (AP2 domain 63-120)
MLAKTHNKGDGSKSLAKILAKWKEYNAQIDSSSDADKPVRKVPAKGSKKGCMKGKGGPENSRCNYRGVRQRTWGKWVAEIREPNRGNRLWLGTFPTAIGAALAYDEAARAMYGSCARLNFPNVSVSSFSEESSKDSPVANHCGSSMAVSANESMISPSNSGVGAEDDVDMEPISLSLTVKHENGEGESGISSSPPSP

SEQ ID NO: 213 - DNA, 594 bp, Glycine max
  Glyma13g38030.1
atgttagccaaggcccataacaaaggggatggatctaagtccctggctaagatactggcaaaatggaaagaatataatgcccagattgattccagcagtgatgcagataagccaattcgcaaagttcctgccaaaggatcgaagaaggggtgcatgaaaggtaaaggggggccagagaactcacggtgtaactaccgaggtgtcaggcaaaggacttggggaaagtgggttgctgaaattcgagagccaaacagaggcaataggctttggctaggtactttccccactgccattggagctgcccttgcatatgatgaagcggccagggcaatgtacggttcctgtgcccgtctcaactttcccaatgtttcagtttccagtttctctgaggaatcttccaaagattctccgtctgcgaatcattgtggttcctcaatggcagtgtctgcaaacgagtccatgatttcacctagtaactctggggtagatgcagaagaggatgttgatatggagcccatttccttatccttaagtgtaaagcatgagaatggggaaggtgaatcggggataagttcatcccctccttcttcctca

SEQ ID NO: 214 - protein, 198 aa, Glycine max
  Glyma13g38030.1 (AP2 domain 63-120)
MLAKAHNKGDGSKSLAKILAKWKEYNAQIDSSSDADKPIRKVPAKGSKKGCMKGKGGPENSRCNYRGVRQRTWGKWVAEIREPNRGNRLWLGTFPTAIGAALAYDEAARAMYGSCARLNFPNVSVSSFSEESSKDSPSANHCGSSMAVSANESMISPSNSGVDAEEDVDMEPISLSLSVKHENGEGESGISSSPPSSS

SEQ ID NO: 215 - DNA, 1023 bp, Arabidopsis thaliana
  AT2G40340.1
atgccgtcggagattgttgacaggaaaaggaagtctcgtggaacacgagatgtagctgagattctaaggcaatggagagagtacaatgagcagattgaggcagaatcttgtatcgatggtggtggtccaaaatcaatccgaaagcctcctccaaaaggttcgaggaagggttgtatgaaaggtaaaggtggacctgaaaacgggatttgtgactatagaggagttagacagaggagatggggtaaatgggttgctgagatccgtgagccagacggaggtgctaggttgtggctcggtactttctccagttcatatgaagctgcattggcttatgacgaggcggccaaagctatatatggtcagtctgccagactcaatcttcccgagatcacaaatcgctcttcttcgactgctgccactgccactgtgtcaggctcggttactgcattttctgatgaatctgaagtttgtgcacgtgaggatacaaatgcaagttcaggttttggtcaggtgaaactagaggattgtagcgatgaatatgttctcttagatagttctcagtgtattaaagaggagctgaaaggaaaagaggaagtgagggaagaacataacttggctgttggttttggaattggacaggactcgaaaagggagactttggatgcttggttgatgggaaatggcaatgaacaagaaccattggagtttggtgtggatgaaacgtttgatattaatgagctattgggtatattaaacgacaacaatgtgtctggtcaagagacaatgcagtatcaagtggatagacacccaaatttcagttaccaaacgcagtttccaaattctaacttgctcgggagcctcaaccctatggagattgctcaaccaggagttgattatggatgtccttatgtgcagcccagtgatatggagaactatggtattgatttagaccatcgcaggttcaatgatcttgacatacaggacttggattttggaggagacaaagatgttcatggatctaca

SEQ ID NO: 216 - protein, 341 aa, Arabidopsis thaliana
  AT2G40340.1 (AP2 domain 70-127)
MPSEIVDRKRKSRGTRDVAEILRQWREYNEQIEAESCIDGGGPKSIRKPPPKGSRKGCMKGKGGPENGICDYRGVRQRRWGKWVAEIREPDGGARLWLGTFSSSYEAALAYDEAAKAIYGQSARLNLPEITNRSSSTAATATVSGSVTAFSDESEVCAREDTNASSGFGQVKLEDCSDEYVLLDSSQCIKEELKGKEEVREEHNLAVGFGIGQDSKRETLDAWLMGNGNEQEPLEFGVDETFDINELLGILNDNNVSGQETMQYQVDRHPNFSYQTQFPNSNLLGSLNPMEIAQPGVDYGCPYVQPSDMENYGIDLDHRRFNDLDIQDLDFGGDKDVHGST

SEQ ID NO: 217 - DNA, 471 bp, Arabidopsis thaliana
  AT2G40350.1
atgcccaggaaacggaagtctcgtggaacacgagatgtagctgagattctaaggaaatggagagagtacaatgagcagaccgaggcagattcttgcatcgatggtggtggttcaaaaccaatccgaaaggctcctccaaaacgttcgaggaagggttgtatgaaaggtaaaggtggacctgaaaatgggatttgtgactatacaggagttagacagaggacatggggtaaatgggttgctgagatccgtgagccaggccgaggtgctaagttatggctcggtactttctctagttcatatgaagctgcattggcttatgatgaggcttccaaagctatttacggtcagtctgcccgactcaatcttccactgctgccactgtgtcaggctcggttactgcattttctgatgaatctgaagtttgtgcacgtgaggatacaaatgcaagatctggttttggtcaggtcagac

SEQ ID NO: 218 - protein, 157 aa, Arabidopsis thaliana
  AT2G40350.1 (DREB2H, G1755, AP2 domain 65-122)
MPRKRKSRGTRDVAEILRKWREYNEQTEADSCIDGGGSKPIRKAPPKRSRKGCMKGKGGPENGICDYTGVRQRTWGKWVAEIREPGRGAKLWLGTFSSSYEAALAYDEASKAIYGQSARLNLPLLPLCQARLLHFLMNLKFVHVRIQMQDLVLVRSD

SEQ ID NO: 219 - DNA, 540 bp, Glycine max
  Glyma07g19220.1
gagaggaaatcgcggaagagacgcagtggtgaaagtgattctgtggaggacacacttgaaaagtggaaggagtacaacaggcagcaacaacttggctctagagaaaatggggtggaagtgattcacaaagttcctgcaaaagggtcgagaaaaggatgcatgagaggaaagggagggcctcagaactccgattgcaagttcagaggtgtgaggcagaggatttggggtaaatgggttgccgagattcgagaacctatcaatggcaagcttgttggtgagaaagcaaataggctttggcttggtactttctccactgcacttgaggctgctcttgcttatgatgaagcagctaaggccatgtatggcccttgtgcccgtttgaattttcccgagccaatagactctaatggatcatcatcttctagtggaagtgataaaaaatcaccaagtggttcttcggagaatggtggtgatgttgcaatagctgaggagttggaggtgaaccatcgtcggtgtcatgaagacagaccaagattttct

SEQ ID NO: 220 - protein, 181 aa, Glycine max
  Glyma07g19220.1 (AP2 domain 65-129)
ERKSRKRRSGESDSVEDTLEKWKEYNRQQQLGSRENGVEVIHKVPAKGSRKGCMRGKGGPQNSDCKFRGVRQRIWGKWVAEIREPINGKLVGEKANRLWLGTFSTALEAALAYDEAAKAMYGPCARLNFPEPIDSNGSSSSSGSDKKSPSGSSENGGDVAIAEELEVNHRRCHEDRPRFSK

SEQ ID NO: 221 - DNA, 1137 bp, Glycine max
  Glyma18g43750.1
gagaggaaatcgcggaagagacgcaacggtggaagtgattatgtggaagacacacttgaaaagtggaaggagtacaacaggcagcaacaacttggctctagagaaaatggggtggaagtgattcacaaagctcccgcaaaagggtcgagaaaagggtgcatgagaggaaagggagggcctcagaactccgattgcaagttcagaggtgtgaggcagaggatttggggtaaatgggttgctgagattcgcgaacctatcaatggcaagcttgttggtgagaaagcaaataggctttggcttggtactttctccactgcacttgaggctgctcttgcttatgatgaagcggctaaggccttgtatggcccttgtgcccgtttgaatttttccgagtcaatagactctaatggatcatcatcttctagtggaaagaatggttgtgatgttgcaaaagctgaggaattggaggtgaaccgtcatcggtgtcatgaagagaaaccaagattttctaaggttggtgtctttgaggagacagaagagaaaccgattctttctggaggttgtgtggctgatgactcaatagaggagttgaaggaaatcacaactggctttgaacagtgtcaaacaagtgaagaatgtatggcaacaactttgaaaaatgttaagtctgaagtaccaggagaaagtgaagaaatggagagagaattggaggaggttgtgaaaaactctggcataggtggagagattttgctcaagagtgaagaaacaagaggagaatcagttgaaactttgaactcttataccaatctaagaccaaatcctgaggcatctattgcaaagaaacatactgaggaagtaatttctgaaatcctaggactatgtcaaggcaagtgcttgaagattagccatggggactccaatcatccttctatgcagggaattcatctgtttggtggtggcactgttggaccaattgaaagtatgtcccaactgcacaaacttggtggataccttcctgagcattggaatagtgtgcagtttccagacttggaagttggtcatgattatagtttcttaaatcctgattatgattttggtttatatgaagagcagaagttacttgatatatgctttcca

SEQ ID NO: 222 - protein, 380 aa, Glycine max
  Glyma18g43750.1 (AP2 domain 65-129)
ERKSRKRRNGGSDYVEDTLEKWKEYNRQQQLGSRENGVEVIHKAPAKGSRKGCMRGKGGPQNSDCKFRGVRQRIWGKWVAEIREPINGKLVGEKANRLWLGTFSTALEAALAYDEAAKALYGPCARLNFSESIDSNGSSSSSGKNGCDVAKAEELEVNRHRCHEEKPRFSKVGVFEETEEKPILSGGCVADDSIEELKEITTGFEQCQTSEECMATTLKNVKSEVPGESEEMERELEEVVKNSGIGGEILLKSEETRGESVETLNSYTNLRPNPEASIAKKHTEEVISEILGLCQGKCLKISHGDSNHPSMQGIHLFGGGTVGPIESMSQLHKLGGYLPEHWNSVQFPDLEVGHDYSFLNPDYDFGLYEEQKLLDICFPH

SEQ ID NO: 223 - DNA, 1176 bp, Glycine max
  Glyma02g42960.1
atgggtgcttatgatcaagtttctcttaagccattggattcttctagaaagaggaaaagtaggagcagaggggatgggtccaaatctgtggctgagactattgcaaagtggaaggaatacaatgagcatctttattctggcaaagatgatagtagaacaactcgtaaggcgccggctaaaggttcgaagaaagggtgcatgaaagggaagggaggacctcaaaattctcagtgtaactacagaggagttaggcagaggacatgggggaaatgggttggtgagattagggaacccaatagaggaagcaggctttggttgggtaccttctcttctgcccaggaagctgctcttgcctatgatgaagctgctagagctatgtatggtccttgtgcacgcctcaattttcccaaaatcacagattatccttctgttaaggaatcgttgaaggactcttcgatggctgcatcgtcgtcttgttcttcggcagcaactgcagcatctgacactactactacaacatcgaaccaatcggaggtttgtgctgttgaggatgttatcgagaaacctgcgaatgtgaatgataagtttaatgattgtcataaggcttacgtatctgcctcaccaactagtagaatgaagcaagagcctaaggatgaggctgtggaccacatggacacaggggctggggaaattcaagatgtcggactagaaggaacacatgatactgggcaggttgcagagaatgtaaataaagatcagatggatttgtcatggattgatggctttgactttattgacgattacttgaagagcttttccgcggatgagttatttcaggtggatgaacttttggggcttatagataataacccaattgataactctgtgttgatgcaaggtttggattttggacaaatgggttttcctggagatggtaatcctcaggttgacgatactccttcaagctttatttatcagttgcaaaatccagatgccaagttgttaggaagtttgccccatatggagcagacaccatcgggtgttgattatggattagatttcttgaaaacagtggagccaggggactataatggtggaggggaagaaccaccatttcttaatttggatgatgatctgaaccatgattcaaatggcatgcaagcaaggaagggtggc

SEQ ID NO: 224 - protein, 392 aa, Glycine max
  Glyma02g42960.1 (AP2 domain 78-135)
MGAYDQVSLKPLDSSRKRKSRSRGDGSKSVAETIAKWKEYNEHLYSGKDDSRTTRKAPAKGSKKGCMKGKGGPQNSQCNYRGVRQRTWGKWVGEIREPNRGSRLWLGTFSSAQEAALAYDEAARAMYGPCARLNFPKITDYPSVKESLKDSSMAASSSCSSAATAASDTTTTTSNQSEVCAVEDVIEKPANVNDKFNDCHKAYVSASPTSRMKQEPKDEAVDHMDTGAGEIQDVGLEGTHDTGQVAENVNKDQMDLSWIDGFDFIDDYLKSFSADELFQVDELLGLIDNNPIDNSVLMQGLDFGQMGFPGDGNPQVDDTPSSFIYQLQNPDAKLLGSLPHMEQTPSGVDYGLDFLKTVEPGDYNGGGEEPPFLNLDDDLNHDSNGMQARKGG

SEQ ID NO: 225 - DNA, 1179 bp, Glycine max
  Glyma14g06080.1
atgggtgcttatgatcaagtttctcttaagccattggattcttctagaaagaggaaaagtaggagcagagggtatgggactggatccgtggctgagactattgcaaagtggaaggaatacaacgaacatctttattctggcaaagatgatagtagaacaactcgaaaggcaccggctaaaggttcgaagaaagggtgcatgaaagggaagggaggacctcaaaactctcagtgtaactacagaggagttaggcagaggacatgggggaaatgggttggtgagattagggagcccaatagaggaagcaggctttggttgggtaccttctcttctgcccaggaagctgctcttgcctatgatgaagctgctagagctatgtatggtccttgtgcacgcctcaattttcccggcatcacagattatgcttcttttaaggaatcgttgaaggaatctccgatggccgcatcgtcctcttgttcttcggcagaaactgcaacatctgacactactactacatccaaccaatcggaggtttgtgcagctgaggatgttaaggagaatcctcgacttgtcaatgtgaatgataaggttaacgattgtcataaggcttatgaagctgcctcaccaactagcagaatgaagcaagagcctaaggatgaggctgtggatcacatggtccccggggctgggaaaattctagatgtcagaccagaaggaacacatgatgccgggcaggttgcagaggatgtaaacaaagatcagatggacttgccatggattgatggctttgattttagtgacaattacttgaacaggttttccacggatgagttatttcaggtggatgaacttttggggcttatagataataacccaattgatgagtctgcgttgatgcaaagtttggattttggacaaatgggttttcctggagatggtaatcctcaggtggatgatacgctttcaagctttatttatcagttgcaaaatccagatgccaagttgttgggaagtttgccccatatggagcagacaccttcaggttttgattatggattagatttcttaaaaacagtggagtcaggggattataatggtggaggggaagaaccgcgatttcttaatttggatgatgatctgaaccctgattcaaagggcatgcaagcaaggaaggatgac

SEQ ID NO: 226 - protein, 393 aa, Glycine max
  Glyma14g06080.1 (AP2 domain 78-135)
MGAYDQVSLKPLDSSRKRKSRSRGYGTGSVAETIAKWKEYNEHLYSGKDDSRTTRKAPAKGSKKGCMKGKGGPQNSQCNYRGVRQRTWGKWVGEIREPNRGSRLWLGTFSSAQEAALAYDEAARAMYGPCARLNFPGITDYASFKESLKESPMAASSSCSSAETATSDTTTTSNQSEVCAAEDVKENPRLVNVNDKVNDCHKAYEAASPTSRMKQEPKDEAVDHMVPGAGKILDVRPEGTHDAGQVAEDVNKDQMDLPWIDGFDFSDNYLNRFSTDELFQVDELLGLIDNNPIDESALMQSLDFGQMGFPGDGNPQVDDTLSSFIYQLQNPDAKLLGSLPHMEQTPSGFDYGLDFLKTVESGDYNGGGEEPRFLNLDDDLNPDSKGMQARKDD

SEQ ID NO: 227 - DNA, 861 bp, Populus trichocarpa
  POPTR_0008s07360.1
atgggtactcttattcaaggttctaacgccacttccatgtccatggattctactaagaagaggaaaagggcaagtgataaatctgtagctgagacccttcaaaagtggaaggaatacaatgagcatcttgatgctcaaggtgatggaggtaataaaccagttcgtaaagttcctgccaagggctcaaagaaggggtgcatgaaaggtaaaggagggccagagaattcagtctgcaattacagaggtgtgagacagaggacatgggggaagtgggttgctgagattcgggagccaaacagagggcctaggctatggcttggtacttttcctactgcctatgaagctgctcttgcctatgataatgctgcacgagctatgtatggttcttgtgctcgtttaaacattccagaagtggtgaattcaacaagctcatcgaaggataacttctctgctgtgacaccatcatactattcttcagctgcaagtcctgctgactccgtcaccacatcaacccactctgaggtttgtgcgtacgaggatcctaaccagaatgtattaagccaagctgaggattggatgacaaatatatcaagccaagctgaggtttgcgagcagaatgtatcaagccaagctgaggtttacgaacagaatgtatcaagccaacatattgaggattgttctcggggagttgaaaaaaatagcaagctgagtcaagatgagctgaagattcaatcagaaaatccttcgtggaccaatgactggcacagctacggctgggatgagatctttagcgtagaagagctgctaggggatattgattctgggatgacaggagcagaggggtacttcagcttaggattt

SEQ ID NO: 228 - protein, 287 aa, Populus trichocarpa
  POPTR_0008s07360.1 (AP2 domain 78-135)
MGTLIQGSNATSMSMDSTKKRKRASDKSVAETLQKWKEYNEHLDAQGDGGNKPVRKVPAKGSKKGCMKGKGGPENSVCNYRGVRQRTWGKWVAEIREPNRGPRLWLGTFPTAYEAALAYDNAARAMYGSCARLNIPEVVNSTSSSKDNFSAVTPSYYSSAASPADSVTTSTHSEVCAYEDPNQNVLSQAEDWMTNISSQAEVCEQNVSSQAEVYEQNVSSQHIEDCSRGVEKNSKLSQDELKIQSENPSWTNDWHSYGWDEIFSVEELLGDIDSGMTGAEGYFSLGF

SEQ ID NO: 229 - DNA, 849 bp, Populus trichocarpa
  POPTR_0010s19100.1
atgggtactcttgatcaatattctaaagctacttctatgcctacggatcctactaagaagaggaaaagggtaatcaataaatctgtagccgagacccttaaaaagtggaaggagtataatgagtatcttgattctcaaggtgatggaggtaataaaccagttcgtaaagttcctgccaagggctcaaagaaggggtgtatgaaaggtaaaggaggaccagagaattcagtctgcaattacagaggagtgagacagaggacatgggggaagtgggttgctgagattcgggaaccaaacagaggccctaggctatggcttggtacttttcctactgcctacgaagctgctcttgcctatgatgaagctgcacgagctatgtatggcccgtatgctcgtttaaatgttcctgatgtgctgaattcaacaagctcatcgaaggacaacttctcctcagcgacaccatcttgctattctccagcagcgagttctgcggactctgctactacatcaacccactctgaggtctgcgtgtatgaggatcctaagcagaatgtatacagccaagctgaggtttgtgggaaggatgtatctagccaagctgaggttcttgcgcatcatatatcaagccaacaacatattgaggatggttcgcagggagttgaaaatagcacgctgagggacgagcagaagagtcaatcagaaaatcctttgtggactccatcagaaaattccttgtggaccaatgactggcacaactactcgatggatgaaatatttagctttgatgagttgctagggggtattgatgcggggatgatgggggcagaagggtacttcaacttgggattt

SEQ ID NO: 230 - protein, 283 aa, Populus trichocarpa
  POPTR_0010s19100.1 (AP2 domain 78-135)
MGTLDQYSKATSMPTDPTKKRKRVINKSVAETLKKWKEYNEYLDSQGDGGNKPVRKVPAKGSKKGCMKGKGGPENSVCNYRGVRQRTWGKWVAEIREPNRGPRLWLGTFPTAYEAALAYDEAARAMYGPYARLNVPDVLNSTSSSKDNFSSATPSCYSPAASSADSATTSTHSEVCVYEDPKQNVYSQAEVCGKDVSSQAEVLAHHISSQQHIEDGSQGVENSTLRDEQKSQSENPLWTPSENSLWTNDWHNYSMDEIFSFDELLGGIDAGMMGAEGYFNLGF

SEQ ID NO: 231 - DNA, 1197 bp, Solanum lycopersicum
  Solyc05g052410.1.1
atgatgttacctatggattatacaaggaagaagaaatcaaggagtagaaaagatgcaccaaagaatgtagcggagacacttgcgaagtggaaagaggtgaatgagaaattagacgcgtgtgatgatgatggaaggaagccagtgcgtaaagttcctgctaaaggatcaaagaagggatgtatgaagggtaaaggaggaccggataacgggcggtgcaagtatagaggtgtcaggcaaaggacatggggtaaatgggttgctgagataagggagccacatagagggagaaggctttggttgggtacgtttgatacggcaattgaggctgctcttgcttatgatgaagctgcaagggcgatgtatggtccttgtgcaaggctgaatctcccggactattacgcctcgtcgaaagagtcttccaaggatgattcttcgttgcctactgtatctcgttccgactcaaatacagcatcaagtttctctgaggtgtgccctgctggtgacatgatgagaggaagagccaatgttcctgcggcaagacatgaagatagatcaatagaaattgacggtgctaggactggttctaatgaaattggaacgcctttgagctcattgagagaggaagcggaagacgagaccaaggaggtgtcagataaaagtgagacttttacacctctgagctcgttgagagagcaagcggaagatgaggctaagcaggtgttagataaaagtgagacctttgaaattaaagatgagcctgcggcttgtagttatgattcatgggatatcggacaagaggacctaggtaacttttgtttggatgatgagatgtttgatgtaaatgagctgttaggcatgatggactcgactccagtagatgcctcagctccaagtcaggatgttggttttgttcctcctaagcaagagcagtatgcctatgatccttcatatcaattgcattctgctgcctacgatgccaatcagttgtcaaatccagcataccagttggacaatgccgatgaccagttctcaaatccattatatcagttggataatgcaggtgttgatacattggaaggtctgcagcaaatggagcaacaatcacctatcgaggttgattatgattttgattttctgagaccaggccggcaagaggacttccacttctgcttggatgagttggatgtcttggatttc

SEQ ID NO: 232 - protein, 399 aa, Solanum lycopersicum
  Solyc05g052410.1.1 (AP2 domain 72-129)
MMLPMDYTRKKKSRSRKDAPKNVAETLAKWKEVNEKLDACDDDGRKPVRKVPAKGSKKGCMKGKGGPDNGRCKYRGVRQRTWGKWVAEIREPHRGRRLWLGTFDTAIEAALAYDEAARAMYGPCARLNLPDYYASSKESSKDDSSLPTVSRSDSNTASSFSEVCPAGDMMRGRANVPAARHEDRSIEIDGARTGSNEIGTPLSSLREEAEDETKEVSDKSETFTPLSSLREQAEDEAKQVLDKSETFEIKDEPAACSYDSWDIGQEDLGNFCLDDEMFDVNELLGMMDSTPVDASAPSQDVGFVPPKQEQYAYDPSYQLHSAAYDANQLSNPAYQLDNADDQFSNPLYQLDNAGVDTLEGLQQMEQQSPIEVDYDFDFLRPGRQEDFHFCLDELDVLDF

SEQ ID NO: 233 - DNA, 900 bp, Solanum lycopersicum
  Solyc06g050520.1.1
atggctattatggatgaagctgctaatatggtttgtgtgccgttggattatagtagaaagaggaaatcaaggagtagaagggacagaacaaaaaatgtggaagagacactagctaaatggaaggagtataatgagaaactagacaatgaagggaaagggaagccagtgcgtaaagttcctgctaaaggttcaaagaaggggtgtatgagaggtaaagggggaccagaaaattggcggtgtaaatacagaggtgttagacagaggatatggggtaaatgggttgctgagattagggaacctaaaagaggtagtaggttatggttgggtacatttggtacagcaattgaagctgctttagcatatgatgatgctgcaagagctatgtatggtccttgtgcaaggcttaatttgccaaattacgcgtgtgattctgtttcctgggcaactacatctgcatctgcatctgcatctgattgcaccgttgcttctggtttcggcgaggtatgtccggttgatggtgctcttcatgaagctgacacaccattgagctcagtgaaagacgaagggaccgcgatggatattgttgaacctacgagtattgatgaagatacgcttaagtctggatgggattgtctagataaattaaatatggatgagatgtttgatgtagatgagctattggctatgttagattctactccagttttcaccaaggactacaattcagatggaaagcacaacaatatggtatcagattcgcaatgtcaggagccgaatgcagtggtagatcctatgactgttgactatggctttgattttctgaaaccaggcaggcaagaagatcttaatttcagttcggatgaccttgcattcatagacttggattctgaacttgtcgtt

SEQ ID NO: 234 - protein, 300 aa, Solanum lycopersicum
  Solyc06g050520.1.1 (AP2 domain 80-137)
MAIMDEAANMVCVPLDYSRKRKSRSRRDRTKNVEETLAKWKEYNEKLDNEGKGKPVRKVPAKGSKKGCMRGKGGPENWRCKYRGVRQRIWGKWVAEIREPKRGSRLWLGTFGTAIEAALAYDDAARAMYGPCARLNLPNYACDSVSWATTSASASASDCTVASGFGEVCPVDGALHEADTPLSSVKDEGTAMDIVEPTSIDEDTLKSGWDCLDKLNMDEMFDVDELLAMLDSTPVFTKDYNSDGKHNNMVSDSQCQEPNAVVDPMTVDYGFDFLKPGRQEDLNFSSDDLAFIDLDSELVV

SEQ ID NO: 235 - DNA, 903 bp, Zea mays
  GRMZM2G047999_T01
atgcaacagcagcaaccactttctctccgtctctcagctctcgcatcaacaaccgccaccaataactctctgtattctttctctgtgtgtgtcttactgtgctcgtgcatggacttctcctacctcttctcgtcgtcgtcctcggagaagaagtcatcgaagcgcctgcagcagcagcagctgctgcagcaacaggacaacaacagcaacgagacaaggtacctcggggtgaggcggcgaccgtggggccggtacgcagcggagatccgggacccggccaccaaggagcggcactggctcggcacgttcgacaccgcggaggaggccgccatcgcctacgaccgcgccgcccgcaacatccgcggcgcaaacgcccgcaccaacttcgcctaccccgacctgccgccgggctcctccgtcaccccatacctctccccggacctctccgccgaccagctccagcactactattacgccaataacgaccccgtagcgcccgccgctgatcagccgccaacgccggcgtgcgatcagtccgcacatggcggcgccgccggcaccgaggcctatcagtactaccaccacgtgccagtggagatgatgtcgtcctacggcgctgccgagggtgcgtcggtaatggactacggcgggaaccccgagatgggcatgtacttcgaaggaaacggctctggtggtgacgacgacagagcgtggtgcgaggcgtcgtcggagctgttgttcggtggttacagcgacgatgcggcggcggcgccggccaacgcgtcgcacgggatgtacttcgaggaagggtacgtgcacagcccaatgttctcgccgatgccggccgccgatgaggtcgatgggttccagctcggcgggccatcgtcgtcttcctattactac

SEQ ID NO: 236 - protein, 301 aa, Zea mays
  GRMZM2G047999_T01 (AP2 domain 73-136)
MQQQQPLSLRLSALASTTATNNSLYSFSVCVLLCSCMDFSYLFSSSSSEKKSSKRLQQQQLLQQQDNNSNETRYLGVRRRPWGRYAAEIRDPATKERHWLGTFDTAEEAAIAYDRAARNIRGANARTNFAYPDLPPGSSVTPYLSPDLSADQLQHYYYANNDPVAPAADQPPTPACDQSAHGGAAGTEAYQYYHHVPVEMMSSYGAAEGASVMDYGGNPEMGMYFEGNGSGGDDDRAWCEASSELLFGGYSDDAAAAPANASHGMYFEEGYVHSPMFSPMPAADEVDGFQLGGPSSSSYYY

SEQ ID NO: 237 - DNA, 717 bp, Oryza sativa
  LOC_Os02g32040.1
atggatttctacttcttctcctcgtcggcgccggcgccggagaagaagacgaggcggcagcagcagcagcagcagcagcgggagcaggaggggggtggaggagggaacgaggcgagatacctcggcgtgaggcggcggccgtggggccggtacgcggcggagatcagggacccggcgaccaaggagcggcactggctgggcacgttcgacacggcggaggaggccgccgtcgcctacgaccgcgccgcccgcaccatccgcggcgccgccgcgcgcaccaacttcgcctacccggacctgcccccgggctcctccctcacgccctacctctcccccgacctctccaccaacgacctccaccgccactactacggcgccggcgccggcgccgacacccagaccgccgccgcgctgccggcgccggctcagcccgcacacggcggcgacgcccaggaaatggcttacggtggcggtggcggtcagaatgtgggtggcgtgttcgacgtcgtcggcggcggcggcggcgcggcgtggtgcgacgcgtcggagctggagttcggcgggtacgacgacgcgggcgcgtcggcggcggcggcggcggtgtacttcgaggaggggtacgtgcacagcccgatgttctcgccgatgcccgcggccgacgaggtcgccgccgacggcttccagctcggcgggtcgtcgtcctcctcgtattactac

SEQ ID NO: 238 - protein, 239 aa, Oryza sativa
  LOC_Os02g32040.1 (AP2 domain 39-102)
MDFYFFSSSAPAPEKKTRRQQQQQQQREQEGGGGGNEARYLGVRRRPWGRYAAEIRDPATKERHWLGTFDTAEEAAVAYDRAARTIRGAAARTNFAYPDLPPGSSLTPYLSPDLSTNDLHRHYYGAGAGADTQTAAALPAPAQPAHGGDAQEMAYGGGGGQNVGGVFDVVGGGGGAAWCDASELEFGGYDDAGASAAAAAVYFEEGYVHSPMFSPMPAADEVAADGFQLGGSSSSSYYY

SEQ ID NO: 239 - DNA, 876 bp, Oryza sativa
  LOC_Os04g32790.1
atgatgaacttctcctcgtacttctactcgtcgtcggcggcggcggcgggtggtggtggtggtggtggggagaagaagtcgtcgtcgtcgtcggcgtcgaagaagaagcagcagcaggcggcggcggcggagggagggaataaccagacgaggtaccttggggtgaggaggaggccgtgggggaggtacgcggcggagatcagggacccggcgacgaaggagaggcactggctggggacgttcgacacggcggaggaggccgccgtcgcctacgaccgcgccgcgaggtcgctccgcggcgcccgcgcgcgcaccaacttcgcctacccggacctccccccgggctcctccgtcaccccctacctctcccccgacctctccgccgacgcctccgatcagctgctccagccgttctacgccaatccctccgccgccgccgcgctgcccactccggcggcggtgatggccggaggaggaggagtcgaattcggcggcgagtacatgtacggcggcggcgtcgacatgtcgtcgctgatggacgacattgcggccatgcccgacgacctcccgcccagcgtgacgggcggcggcggcggcttcgccagcagcgacgaatactccagcggcggcggcgggatggtcgacgacgtctccatgtactgcggcggcaatggcggagggtcgtcgtggtgcgacgcctccgacttcgcctcgtactcgtcctcctcgccggcggcggcggcggcggcaggctcgcacgggatgtacttcgaggaggggtacgtgcacagcccgctcttctcgccgatgccggccgtcgacgacgccggcgccgacgggttccagctcggcggctcgtcgtcgtcctactactac

SEQ ID NO: 240 - protein, 292 aa, Oryza sativa
  LOC_Os04g32790.1 (AP2 domain 51-114)
MMNFSSYFYSSSAAAAGGGGGGGEKKSSSSSASKKKQQQAAAAEGGNNQTRYLGVRRRPWGRYAAEIRDPATKERHWLGTFDTAEEAAVAYDRAARSLRGARARTNFAYPDLPPGSSVTPYLSPDLSADASDQLLQPFYANPSAAAALPTPAAVMAGGGGVEFGGEYMYGGGVDMSSLMDDIAAMPDDLPPSVTGGGGGFASSDEYSSGGGGMVDDVSMYCGGNGGGSSWCDASDFASYSSSSPAAAAAAGSHGMYFEEGYVHSPLFSPMPAVDDAGADGFQLGGSSSSYYY

SEQ ID NO: 241 - DNA, 816 bp, Zea mays
  GRMZM2G023708_T01
atgaatttctcctcctatttcttctcttcctcctcgtcatcctccgacaagaagtcgtcgtcgtcgtcatccaagcgccggcagcaggcggcgcagccgcagccggacgccaacacgacgcggtacctgggcgtgcggcgccggccgtggggccggtacgcggcggagatccgagacccggccacaaaggagcggcactggctgggaaccttcgacacagccgaggaggcggccgtggcctacgaccgcgccgcgcgctccctccgcggcgcccgcgcgcgcaccaacttcgcctacccggacctcccgccgggctcctccgtcaccccctacctctccccggacctcacctcgggcgacaacgccacgcagctcctccagcccttctacgccgaccccgccgcatcccttgctgcggcggcggcccctgccgcgacgaacggcgcggcgggctacggcgccgccggcgactacgcctcctacggctatagcgccgaggacatgtccgctctcatggaagacctcgccatacccgacgacctgactgccgactacggcgctgaagacgccggcggcggctccgtgaacatgccctccatgtacagcggcggcggcggcgccaatgccagctccggtagcgggtggtgcgacgcgtcggagttcagcgcgtacggtgcgccgacgaccgccgcctcgcacggggtgtacttcgaggaagggtacgtgcatagcccgctcttctcgccgatgccggccgtcgacgacgcctccgccgacggcttccagctcggcggctcctcctcgtcctactactac

SEQ ID NO: 242 - protein, 272 aa, Zea mays
  GRMZM2G023708_T01 (AP2 domain 41-104)
MNFSSYFFSSSSSSSDKKSSSSSSKRRQQAAQPQPDANTTRYLGVRRRPWGRYAAEIRDPATKERHWLGTFDTAEEAAVAYDRAARSLRGARARTNFAYPDLPPGSSVTPYLSPDLTSGDNATQLLQPFYADPAASLAAAAAPAATNGAAGYGAAGDYASYGYSAEDMSALMEDLAIPDDLTADYGAEDAGGGSVNMPSMYSGGGGANASSGSGWCDASEFSAYGAPTTAASHGVYFEEGYVHSPLFSPMPAVDDASADGFQLGGSSSSYYY

SEQ ID NO: 243 - DNA, 813 bp, Zea mays
  GRMZM2G079825_T01
atgaatttctcgtcgtatttcttctcctcgtcatcctcggacaagaagtcgtcgtccaagcgccagcagcagcaggcggcgcagccccagacggacgccaacacgacgcggtacctgggtgtgcggcgccggccgtggggccggtacgcggcggagatccgggacccggccactaaggagcggcactggctgggaaccttcgacacggccgaggaggccgccgtggcctacgaccgcgccgcgcgctccctccgcggcgcccgcgcgcgcaccaacttcgcctacccggacctcccgcctggctcctccgtcacgccctacctctccccggacctcacctcgggcgacaacgccacgcagctcctccagccattctacgccgccgacgcagccgccgcgtctctaccaccggcgctcccggccgcgaacggcgcggcgggctacggcgccgccgccggcgactacgcctcctacggctatagtgccgaggacatgtccgctctcatggacgacctcaccatacccgacgacctgaccgctgactacggcgcagaagacgccggcggctccgtggacatgtcctccatgtacggcggcggcggcagcagcgccaatgccagctccgccagcagcggcgggggcgggtggtgcgacgcgtcggagttcagcgcgtacggcgcgtcggccgcctcccacggggtctacttcgaggaagggtacgtgcacagcccgctcttctcgccgatgccggccgtcgacgacgcctgcgccgacggcttccagctcggcggctcctcgtcttcatactactac

SEQ ID NO: 244 - protein, 271 aa, Zea mays
  GRMZM2G079825_T01 (AP2 domain 37-100)
MNFSSYFFSSSSSDKKSSSKRQQQQAAQPQTDANTTRYLGVRRRPWGRYAAEIRDPATKERHWLGTFDTAEEAAVAYDRAARSLRGARARTNFAYPDLPPGSSVTPYLSPDLTSGDNATQLLQPFYAADAAAASLPPALPAANGAAGYGAAAGDYASYGYSAEDMSALMDDLTIPDDLTADYGAEDAGGSVDMSSMYGGGGSSANASSASSGGGGWCDASEFSAYGASAASHGVYFEEGYVHSPLFSPMPAVDDACADGFQLGGSSSSYYY

SEQ ID NO: 245 - DNA, 735 bp, Arabidopsis thaliana
  AT1G28160.1
atggagttcaatggtaatttgaatgccggttcttgctctagatcaaaaaagagtcataggcaaaagcagcaacaaccgcagccacagccacaacaacatattgaagaaataaagtatgtaggagtgaggaggaggccatggggaagatatgcagctgagataagaaacccgacgacgaaagagaggtattggctaggtacttttgacacggccgaggaggctgcattggcttatgatagagccgcacggtccataagaggcttgactgctcgaaccaactttgtctactccgatatgcctcgtggctcctcagtaacttcctttgtgtctcctgatgaatcccaacgtttcatttccgagttattcaaccctccaagccaactagaagctactaacagcaacaataacaacaataacaatctctactcatcgaccaacaaccaaaaccagaactctattgagttctcatacaatgggtggcctcaggaggctgaatgtggttatcaatctataaccagtaatgctgagcattgtgatcatgagcttccacctcttcctcccagtacttgttttggagctgaactgaggattccggagacggatagctattggaatgttgcgcatgcaagcatagacacgtttgccttcgagcttgatggctttgtggatcaaaacagtcttggtcagagtggaacagaagggtttaattctttaccctccacattcttctaccaa

SEQ ID NO: 246 - protein, 245 aa, Arabidopsis thaliana
  AT1G28160.1 (ERF087, G2292, AP2 domain 38-101)
MEFNGNLNAGSCSRSKKSHRQKQQQPQPQPQQHIEEIKYVGVRRRPWGRYAAEIRNPTTKERYWLGTFDTAEEAALAYDRAARSIRGLTARTNFVYSDMPRGSSVTSFVSPDESQRFISELFNPPSQLEATNSNNNNNNNLYSSTNNQNQNSIEFSYNGWPQEAECGYQSITSNAEHCDHELPPLPPSTCFGAELRIPETDSYWNVAHASIDTFAFELDGFVDQNSLGQSGTEGFNSLPSTFFYQ

SEQ ID NO: 247 - DNA, 897 bp, Eucalyptus grandis
  Eucgr.B03565.1
atggatcacctgaacttcaccgtctcgtcgtcgccggtcaactcgccatcaccttcaaaggccaaaagaaagcatcagcagcagcaaacgccgccccccctccaaacccaccaggacgacggggcagccccagccaggttcctcggggtcaggcggcgtccgtggggccggtacgcggcggagatacgggaccccaccacaaaggagcggcactggctcgggaccttcgacacggccgaggaggccgccctggcctacgaccgggccgcccggtcgatgcggggcgccaaggctcgcaccaacttcgtctactccgacatgccgccgggctcctcggtcacctccctcgtctcccccgacgaggcccacagcgacttcgccgcgctcttcatctctcaacatcatcatcagcagcaagagcaaccacatcatcatcaccacggcaagagcagcaataaccctaatcaccagctcttttacacgccgggctccatgagcgcctgcaacgtggacttcacatccgggctacccgccgaaaacgggtgggccgccgacggatatctcggcggcggtccctaccatccggcgacgagcatcgccgacttcggggacgcagcccgcccgcagtcctacgacgaggcggagctgccaccgtttccgcccgacctgtccagctgttacggttcgggcttggatatgggccacggaggctggacagatatgggctttttggggctccaggagcagagcattgtgcctgggccgtcgaacgggctgaacatgggctttgacccaaacgagctcgtggagcacggcccactcttcgggaggatgccgcaggtctcggataagggcgtggacgggtttgatttgggctcgtcttctgcgtactatttt

SEQ ID NO: 248 - protein, 299 aa, Eucalyptus grandis
  Eucgr.B03565.1 (AP2 domain 46-109)
MDHLNFTVSSSPVNSPSPSKAKRKHQQQQTPPPLQTHQDDGAAPARFLGVRRRPWGRYAAEIRDPTTKERHWLGTFDTAEEAALAYDRAARSMRGAKARTNFVYSDMPPGSSVTSLVSPDEAHSDFAALFISQHHHQQQEQPHHHHHGKSSNNPNHQLFYTPGSMSACNVDFTSGLPAENGWAADGYLGGGPYHPATSIADFGDAARPQSYDEAELPPFPPDLSSCYGSGLDMGHGGWTDMGFLGLQEQSIVPGPSNGLNMGFDPNELVEHGPLFGRMPQVSDKGVDGFDLGSSSAYYF

SEQ ID NO: 249 - DNA, 879 bp, Populus trichocarpa
  POPTR_0001s12820.1
atggattttacttactcgacaaaaaccaactcatcaccctctccttcaaagaccaaaagaaagcagcagcagcagcagcagcagaaccaacaagaacaacaagaagtgaggttcttaggggtaaggagaaggccatggggtagatatgctgcagaaataagagacccttcaacaaaagagaggcactggcttggtacttttgacacagctgaggaagctgccttggcttatgaccgtgcagccaggtccatgcggggctccaaagcacgcaccaactttgtctactcagacatgcctcctgcctcctctgtaacttgcattatctcaccagacgagtcacaacatgacaattcggccctctttgctcctcctccacaacacaatactcatcaaaatgacaccaactgccagcagctctacttctctcaggatcagcaacccttcaatgctcatgcttatggtaacagtaatagcaactggttagcaggtggagcaggctgggttcaaggatttggagctggggctggagatgggccttgtgggtcttatgagcccaacagtgctggcagtctggatgtcgctagtgggcttaactatctctctaacacggacaacattgagctcccgcctttgcctcctgatgtcaactctagctgttatgggtgtgatatgggtcgtgaattttggaatgacacagggtttctcgggtttcaagaggaacagctagatgatgtgaatgggcttgaagtgagtgggtccatattgggctttgattctaatgaatttgggctgcacggctcgttatttgggatcgtgccatcggtatcgaatacggtcacagacgggtttgatttgggctcatcatctaccttttatttt

SEQ ID NO: 250 - protein, 293 aa, Populus trichocarpa
  POPTR_0001s12820.1 (AP2 domain 37-100)
MDFTYSTKTNSSPSPSKTKRKQQQQQQQNQQEQQEVRFLGVRRRPWGRYAAEIRDPSTKERHWLGTFDTAEEAALAYDRAARSMRGSKARTNFVYSDMPPASSVTCIISPDESQHDNSALFAPPPQHNTHQNDTNCQQLYFSQDQQPFNAHAYGNSNSNWLAGGAGWVQGFGAGAGDGPCGSYEPNSAGSLDVASGLNYLSNTDNIELPPLPPDVNSSCYGCDMGREFWNDTGFLGFQEEQLDDVNGLEVSGSILGFDSNEFGLHGSLFGIVPSVSNTVTDGFDLGSSSTFYF

SEQ ID NO: 251 - DNA, 885 bp, Populus trichocarpa
  POPTR_0003s15940.1
atggattttactcagtcaacaaaaaccaactctacaccctctccttcgaagaacaaaagaaagcagcagcagcagcagcagaaaaaccagaaccaacaagaacaacatgaggtaaggtttttgggggtaaggagaaggccatggggcagatacgctgcagagataagagacccttcaacaaaagagaggcattggcttggtacttttgacaccgctgaggaggctgccctggcttatgaccgtgcagccaggtccatgcgaggctccaaagcccgcaccaactttgtctactcggacatgcctcctgcctcctccgtcacttccattatctcaccagacgaatcccaacatgacatctcagccctctttgctcctcctccacaaaaccatgctcatcaaaatgacaccaactgccaaaagctcttcttctctcaggatcagtaccccttcaatgcttatgcttatggtaacagtaatagcaacttgttaacaggtggagaaggttgggttcaaggatgtggagctggtgctgcagatggccctggagggtcttatgagcccaataatgctggcagttttggtgtcgctactgagcccatctatttctctaacaaggacaatattgagctcccacctttgcctcctgatgtcaactccagctgctatgggtctgatatggatcatggattctggaacgatgcagggttttttgggtttcaagaggaacagaaaaataacggtaatgggcttgagattagtggatcaagcttgggttttgattcaaatgactttgggcagcatggctcgttatttgagattatgccatcggtatcggacacggtcacagacgagcttgatttgggatcatcatccaccctctacttt

SEQ ID NO: 252 - protein, 295 aa, Populus trichocarpa
  POPTR_0003s15940.1 (AP2 domain 39-102)
MDFTQSTKTNSTPSPSKNKRKQQQQQQKNQNQQEQHEVRFLGVRRRPWGRYAAEIRDPSTKERHWLGTFDTAEEAALAYDRAARSMRGSKARTNFVYSDMPPASSVTSIISPDESQHDISALFAPPPQNHAHQNDTNCQKLFFSQDQYPFNAYAYGNSNSNLLTGGEGWVQGCGAGAADGPGGSYEPNNAGSFGVATEPIYFSNKDNIELPPLPPDVNSSCYGSDMDHGFWNDAGFFGFQEEQKNNGNGLEISGSSLGFDSNDFGQHGSLFEIMPSVSDTVTDELDLGSSSTLYF

SEQ ID NO: 253 - DNA, 633 bp, Arabidopsis thaliana
  AT5G13910.1
atgaacacaacatcatcaaagagcaagaagaagcaagacgatcaggttggtacaaggtttcttggggtgagaagaaggccttggggaagatacgcagctgagattagagacccaactacgaaggagcgtcactggcttggcactttcgatacggcggaagaagctgccttggcctacgatagagctgctcggtccatgcgtggcacacgtgccagaaccaactttgtttactcagacatgcctccttcctcatccgtcacctccattgtttctcctgacgatcctcctcctcctccacctcctcctgctcctcctagcaatgatcctgtcgattacatgatgatgtttaaccaatactcatccactgactcgccaatgcttcagcctcattgtgatcaagtggacagttacatgtttggtggctctcaatcttcgaattcttattgctattctaatgacagtagtaatgagctgcctcctctcccgagcgacttgtcgaattcgtgttatagccaaccacagtggacctggaccggtgacgactactcgtctgagtacgtacatagtccaatgttcagcagaatgcctccggtttctgactctttccctcaaggtttcaactactttggctcc

SEQ ID NO: 254 - protein, 211 aa, Arabidopsis thaliana
  AT5G13910.1 (AP2 domain 19-82)
MNTTSSKSKKKQDDQVGTRFLGVRRRPWGRYAAEIRDPTTKERHWLGTFDTAEEAALAYDRAARSMRGTRARTNFVYSDMPPSSSVTSIVSPDDPPPPPPPPAPPSNDPVDYMMMFNQYSSTDSPMLQPHCDQVDSYMFGGSQSSNSYCYSNDSSNELPPLPSDLSNSCYSQPQWTWTGDDYSSEYVHSPMFSRMPPVSDSFPQGFNYFGS

SEQ ID NO: 255 - DNA, 822 bp, Populus trichocarpa
  POPTR_0001s15710.1
atgaatccatcttcatcaaacagaaaaaagaagcaacctcaacaagtacagcaggaaccaggtactggattaaggtttctaggagttaggagaaggccatggggaagatatgcagcagagataagagacccttcaacaaaagaaaggcattggctaggcacctttgacactgctgaggaagctgccttggcctatgacagagccgctcgctccatgcgcggttctcgtgctcgcacaaactttgtttactctgacatgcctgctggttcttttgtcacatccattatttcccctgatgaacaacaatctctacagcagcagcaacaccagcaacatagtgataataataacaacctgtcttcattattcatcaatgtccctccctctcatgatcatcagccagactcgactcccattttcaaccaggattttagctcccaatgccatttggaagaggggttttcttcaatgacatctggtggaggtttttggagctgctccagtaataatacctataatcaacaactaaaacatgttattcaaaacaatgtgcttcctcatgattttccttccaatatatctcacagttcggattataatatgagtcaatgtagttggactgattcgtcaacttcggggttgatgggttttgaggaccagacaacaatgactagtgggtttgagtcagtggggagtagtagtggttcgtatttcgggtttgattctggagagtatgtgcacagtccactttttagcaggatgcccccagtctcagatatggtaccagatggttttgatttgggctcctctgcttattttttc

SEQ ID NO: 256 - protein, 274 aa, Populus trichocarpa
  POPTR_0001s15710.1 (AP2 domain 25-88)
MNPSSSNRKKKQPQQVQQEPGTGLRFLGVRRRPWGRYAAEIRDPSTKERHWLGTFDTAEEAALAYDRAARSMRGSRARTNFVYSDMPAGSFVTSIISPDEQQSLQQQQHQQHSDNNNNLSSLFINVPPSHDHQPDSTPIFNQDFSSQCHLEEGFSSMTSGGGFWSCSSNNTYNQQLKHVIQNNVLPHDFPSNISHSSDYNMSQCSWTDSSTSGLMGFEDQTTMTSGFESVGSSSGSYFGFDSGEYVHSPLFSRMPPVSDMVPDGFDLGSSAYFF

SEQ ID NO: 257 - DNA, 825 bp, Populus trichocarpa
  POPTR_0003s07540.1
atgaatccatcttcatcgaaaagcaaaaggaagcaaccacaacaagtacagcaggaaccgggtactggattaaggtttcttggtgttaggagaaggccatggggaagatatgcagcagagataagagacccttcaacaaaagaaaggcattggctaggcacctttgacactgccgaggaagctgccttggcctacgacagagccgctcgctccatgcgcggtcctcgtgctcgcacgaactttgtttactctgacatgcctgctggttcatccgttacctccattatctcccctgatgaccagcaatctctacagcagcagcaactccagcaaaatagcgaccataatagcaacctgtcctcattattcttcaatgcccggcctccctctcatgatcttcagccggactcgactcccattttcaaccaggattttacctctcaatgccatttgtcagacgggttttcttcaatgacttctggtggagattcttggtgctgctccagcaccagaactgataatcaacagctacaacatgttaatgattacaatgtgcttcctcatgagtttccttctgatatatctcacgactcgggttatagtatgggtcagtgtggtttgaccgattcatcatcttcaaggctgatgggttttgaggaccagacagcaatgaccactggatttgactcagtcgggggtggtagtggttcttatttcgggtttgattctggcgaatacgttcacagtccactttttagcaggatgccgccagtttcagatatggcaccagatggttttgatttgagctcctctgcttatttcttc

SEQ ID NO: 258 - protein, 275 aa, Populus trichocarpa
  POPTR_0003s07540.1 (AP2 domain 25-88)
MNPSSSKSKRKQPQQVQQEPGTGLRFLGVRRRPWGRYAAEIRDPSTKERHWLGTFDTAEEAALAYDRAARSMRGPRARTNFVYSDMPAGSSVTSIISPDDQQSLQQQQLQQNSDHNSNLSSLFFNARPPSHDLQPDSTPIFNQDFTSQCHLSDGFSSMTSGGDSWCCSSTRTDNQQLQHVNDYNVLPHEFPSDISHDSGYSMGQCGLTDSSSSRLMGFEDQTAMTTGFDSVGGGSGSYFGFDSGEYVHSPLFSRMPPVSDMAPDGFDLSSSAYFF

SEQ ID NO: 259 - DNA, 756 bp, Eucalyptus grandis
  Eucgr.I01576.1
atgagctcgccgtcctcctcctccaaaggcaataagaagcagccccccgccggggagagctcggccgcgggcggcggccggttcctgggcgtccggcggcgcccctggggccggtacgcggccgagatacgggacccctccaccaaggagcggcactggctcggcaccttcgacacggccgaggaggccgccctggcctacgaccgggccgcccgctcgatgcgcgggtcgcgggcccgcaccaacttcgtgtactccgacctccccgccggctcctccgtgacctccatcctctcccccgacgaggcccagcagcagaacttctcccccatcttcgccaactcggcgccccggcccgacccggccccgcagctggacgcgggcggttacgccgagagcgcctggtccacttccgcgtactacagccagcaagccgacgccgcgccctacggcggcggcggcggcggggcctattctcaatgccactatgacaatgtggagctcccccccctgccttccgacatgtcgggctactcgggctactcgggctccgatacctcgagctacagctacggcgacacggtccctagcaactgctactcggatttccacgaccccgccgcagcatcaggcaacgggccttccttcggcttcgactcgacggaggagtacgtgcacagcccgctcttcagcaggatgccgccggtttctgactccgtcccggatagtttcaacctgggcggctcttatttcttc

SEQ ID NO: 260 - protein, 252 aa, Eucalyptus grandis
  Eucgr.I01576.1 (AP2 domain 27-90)
MSSPSSSSKGNKKQPPAGESSAAGGGRFLGVRRRPWGRYAAEIRDPSTKERHWLGTFDTAEEAALAYDRAARSMRGSRARTNFVYSDLPAGSSVTSILSPDEAQQQNFSPIFANSAPRPDPAPQLDAGGYAESAWSTSAYYSQQADAAPYGGGGGGAYSQCHYDNVELPPLPSDMSGYSGYSGSDTSSYSYGDTVPSNCYSDFHDPAAASGNGPSFGFDSTEEYVHSPLFSRMPPVSDSVPDSFNLGGSYFF

SEQ ID NO: 261 - DNA, 786 bp, Glycine max
  Glyma02g07460.1
atgaaaccctacacatcatcaccatcgtcctccaggtccaaaaagaagcaaacaacaacacaacaagatcatgaaacagcatggggaggaaggtaccttggggtgaggaggaggccatggggaaggtatgcagctgaaatccgtgacccttccaccaaggaaagacattggttaggcacgtttgataccgcagaagaggccgccctagcatacgatagggcggcccgctccatgcggggctcacgtgctcgaaccaactttgtctatccggacactcctccgggttcctccgtcacctccatcctttctccggacgagcaaacccaaacccaaatccaccaggcccaagaagagctctcctctctattcaatccgaacccgtttgcacaacccgacccaaacccgcatttttccttatgcgggtattcgggtgtcacgaacactcctacattttctgccaccgaagaaattgccccatccggtggctatagctataattatggatacactgaaggaggaaccagcatggagagttcacattttaagctctttgatgatggtgaaacggagcttccaccattgccaccggatatcacaagctccatgggctatgaaatgggtaatggtttcggcgctaatgctaccgggtcaggttacccatattcgggatttggatccggtgattacgtggtgcatagtccactctttagcgcaatgccaccagtgtcagataatgtttcaacgggccatgagggttttgatttggcaagctcttcttttttcttc

SEQ ID NO: 262 - protein, 262 aa, Glycine max
  Glyma02g07460.1 (AP2 domain 31-94)
MKPYTSSPSSSRSKKKQTTTQQDHETAWGGRYLGVRRRPWGRYAAEIRDPSTKERHWLGTFDTAEEAALAYDRAARSMRGSRARTNFVYPDTPPGSSVTSILSPDEQTQTQIHQAQEELSSLFNPNPFAQPDPNPHFSLCGYSGVTNTPTFSATEEIAPSGGYSYNYGYTEGGTSMESSHFKLFDDGETELPPLPPDITSSMGYEMGNGFGANATGSGYPYSGFGSGDYVVHSPLFSAMPPVSDNVSTGHEGFDLASSSFFF

SEQ ID NO: 263 - DNA, 822 bp, Glycine max
  Glyma16g26460.1
atgaaaccctacacgtcatcaccatcatcctccaagtccaaaaagaagccaacaacaacacaacaagatcatgaaacagcatggggaggaaggtaccttggagtgaggaggaggccatggggaaggtatgcggccgaaattcgcgacccttccactaaggaaagacattggttgggcacgtttgataccgcagaagaggccgccctagcatatgataaggcggcccgctccatgcggggctcacgtgctcgaaccaacttcatctatccggatactcctccgggttcttctgtcacctccatcctctctccagacgagcaaacccaaacccaaatccaccaggcccaagaagagctctcctctctattcaacccaaacccgtttccacaacctgacccgaacccgcaattttccttatgcgggttttcgggtatcccgaacactcctacattttctgccaccgaagaaattgcctcatccggtggctatagctacagttatggatacaccgaaggaggaaccggcgtggagagttcacattttaagctctttgatgatggtgaaacgcagcttccaccattgccaccggatatcacaagctccatgggctatgaaatgagtaatgggctttatggaaacgatgtcgggttttcggatccaagttgcggagctaatgcttccgggtcgggttacccgtattcggggttcgaatcaggtgattacgtggtgcatagtccactctttagtgcaatgccatcagtgtcagataatgtggcaacgggccatgagggttttgatttgggaagctcttcttatttcttc

SEQ ID NO: 264 - protein, 274 aa, Glycine max
  Glyma16g26460.1 (AP2 domain 31-94)
MKPYTSSPSSSKSKKKPTTTQQDHETAWGGRYLGVRRRPWGRYAAEIRDPSTKERHWLGTFDTAEEAALAYDKAARSMRGSRARTNFIYPDTPPGSSVTSILSPDEQTQTQIHQAQEELSSLFNPNPFPQPDPNPQFSLCGFSGIPNTPTFSATEEIASSGGYSYSYGYTEGGTGVESSHFKLFDDGETQLPPLPPDITSSMGYEMSNGLYGNDVGFSDPSCGANASGSGYPYSGFESGDYVVHSPLFSAMPSVSDNVATGHEGFDLGSSSYFF

SEQ ID NO: 265 - DNA, 645 bp, Vitis vinifera
  GSVIVT01032961001
atgaatccatctacgtcgaagagcaaaaagaagcaaacgcaacagcaggaaacgagtgggaggtttcttggtgttcgaaggaggccgtgggggagatacgcggcggagatacgagacccttctaccaaagagaggcattggctgggcaccttcgacactgcggaggaagccgccttggcctacgacagagccgcacgctcaatgcgtggctctcgcgctcgcaccaacttcgtctactccgacatgccaccgggctcctccgtcacctccatcatctcccctgacgagtccctccccgacttctcctcccacttccctctcgtcgacaacatgaacggcaccaccaccaccaccaacaaccaattctacaatgcaaacgacctccccccattcccttcccaggtttctgatcagctcccgagttcaggtttcgaaatggagcaggcgacatggggcgactcaaccagcctcgcggggttttcggagcagaggacatccccaaatgagtttgactcagcggggggcgggtcttacttgggattcgattccacccagtacgtgcacagcccacttttcggtcggatgcctcccgtttccgacacccctccggatggttttgatctgggttcttcctcgtatttcttc

SEQ ID NO: 266 - protein, 215 aa, Vitis vinifera
  GSVIVT01032961001 (AP2 domain 21-84)
MNPSTSKSKKKQTQQQETSGRFLGVRRRPWGRYAAEIRDPSTKERHWLGTFDTAEEAALAYDRAARSMRGSRARTNFVYSDMPPGSSVTSIISPDESLPDFSSHFPLVDNMNGTTTTTNNQFYNANDLPPFPSQVSDQLPSSGFEMEQATWGDSTSLAGFSEQRTSPNEFDSAGGGSYLGFDSTQYVHSPLFGRMPPVSDTPPDGFDLGSSSYFF

SEQ ID NO: 267 - DNA, 572 bp, Glycine max
  Glyma16g05070.1
gagtcgccgcaccaaagggcatcatcatcatggggagggaggtacctcggcgtgcggcggaggccgtggggtcggtacgcggcggagattcgcgacccttccacgaaggagcggcactggctcggcacgttcgacaccgccgacgaggccgcgctggcgtacgacagagccgcacgtgccatgcggggctcacgtgcccgcaccaacttcgtctacgccgacaccacccccggctcctccgtcacccccatcatttcacccgaccaaccacaacccgacccggttctttcattcgacccgttttccctcctcgccttcccctccggttcttattctgccagcgtggcagcttctcagtttagccaacaacaacaacaaccagataataataataataataatattattaacaatagcaataataataaagatagcacgatagagcttcctccgttgccaccggatattactagctccgtgggttatgaagggttttacaataatgatggagggtattattgggaggaggatgataattacttgcataatccaatgtttagcacaatgccagc

SEQ ID NO: 268 - protein, 192 aa, Glycine max
  misc_feature (192)..(192): xaa can be any naturally occurring amino acid
  Glyma16g05070.1 (AP2 domain 14-77)
ESPHQRASSSWGGRYLGVRRRPWGRYAAEIRDPSTKERHWLGTFDTADEAALAYDRAARAMRGSRARTNFVYADTTPGSSVTPIISPDQPQPDPVLSFDPFSLLAFPSGSYSASVAASQFSQQQQQPDNNNNNNIINNSNNNKDSTIELPPLPPDITSSVGYEGFYNNDGGYYWEEDDNYLHNPMFSTMPAX

SEQ ID NO: 269 - DNA, 633 bp, Brachypodium distachyon
  Bradi4g35950.1
atgaggacgatctgcgatgtgtgcgagagcgcggtggcggtgctcttctgcgcggccgacgaggccgccctctgccgctcctgcgacgagaaggtacatctgtgtaacaagcttgctagtcggcatgtaagggttgggcttgcagaccctaataaattagtacgctgtgatatatgtgaaaattctcctgctttcttctactgtgatatagatggtacatcactttgcctgagttgtgatatggctgttcatgttggtgggaaacgaacccatggaagatatttgctgctaagacaaagggtcgaatttccaggagataaaccagggaatatggatgacgtacctatgcagcagatagaatctgaaaaccagagggaccaaaataaggctcctcattcagtaccgaaggagcaaatggtgagccatcatcatgcctatgataatcatgcctcagatggcaattgcaatgggcagggtaacattgattctaaaatgtttgatcttaatatgagaccagctcgtaatcatgggcaaggttcgagttcacagactcaggcagttgatcatagtgccaacaaccatgactcttcaggagtggtgccaacatgcaatttggaacgagacaccaacaaa

SEQ ID NO: 270 - protein, 211 aa, Brachypodium distachyon
  Bradi4g35950.1 (B-boxes 5-42, 56-91)
MRTICDVCESAVAVLFCAADEAALCRSCDEKVHLCNKLASRHVRVGLADPNKLVRCDICENSPAFFYCDIDGTSLCLSCDMAVHVGGKRTHGRYLLLRQRVEFPGDKPGNMDDVPMQQIESENQRDQNKAPHSVPKEQMVSHHHAYDNHASDGNCNGQGNIDSKMFDLNMRPARNHGQGSSSQTQAVDHSANNHDSSGVVPTCNLERDTNK

SEQ ID NO: 271 - DNA, 633 bp, Oryza sativa
  LOC_Os09g35880.1
atgcggacgatctgcgacgtgtgcgagagcgcgccggcggtgctcttctgcgtggccgacgaggccgcgctctgccggtcctgcgacgagaaggtgcatatgtgtaacaagcttgctaggcggcacgtgagagttgggcttgcagaccctaataaagttcaacgctgtgatatatgtgaaaatgcccccgccttcttctattgcgagatagatggtacatcactttgccttagttgtgatatgactgttcatgttggtgggaaacgaacccatggaagatacctgctcctaaggcaacgggttgaatttccaggagataaaccaggtcatatggatgatgttgctatgcaacagaaagatcctgaaaaccggacggatcaaaagaaggcccctcactcagtaacaaaggagcaaatggcaaaccatcataatgtgtctgatgatccagcctcagatggcaactgcgatgaccagggtaacatcgattccaaaatgattgatcttaatatgagacccgtccgtactcatggacaaggttcaaactcacagactcagggcgtggatgttagcgtcaacaatcatgattctccaggagtggtgccaacatgtaatttcgaacgagaagccaacaaa

SEQ ID NO: 272 - protein, 211 aa, Oryza sativa
  LOC_Os09g35880.1 (B-boxes 5-42, 56-91)
MRTICDVCESAPAVLFCVADEAALCRSCDEKVHMCNKLARRHVRVGLADPNKVQRCDICENAPAFFYCEIDGTSLCLSCDMTVHVGGKRTHGRYLLLRQRVEFPGDKPGHMDDVAMQQKDPENRTDQKKAPHSVTKEQMANHHNVSDDPASDGNCDDQGNIDSKMIDLNMRPVRTHGQGSNSQTQGVDVSVNNHDSPGVVPTCNFEREANK

SEQ ID NO: 273 - DNA, 618 bp, Zea mays
  GRMZM2G143718_T01
atgcggacgatctgcgatgtgtgcgagagcgcaccggcggtgctcttctgtgcggccgacgaggcagcgctttgccggccctgcgacgagaaggtacacatgtgtaacaagcttgctagtcggcatgtgagagttggacttgcagaccctaataaacttgtccggtgtgatatatgtgaaaattcacccgctttcttctactgtgagatagacggcacctcactttgcctgagctgtgatatgactgttcatgttggtggcaagcgaacccatggaagatacctgctcctaaggcaaagggttgaatttccaggagataaaccgggccatatggatgacgtgcctatggaaatccaagatcctgaaaaccagagagaccagaaaaagccacccaaggagcaaacggcaaaccaccataacggcgatgatccggccactgatggcaactgtgatgaccagggtaacattgattcaaaaatgatcgatcttaatatgcgcccggttcgtactcatgggcaagaatcaaattcccagactcagggggtaggtcttagtgtgaacaaccatgactctccaggggtggtgccaacaagcaattccgaaagagacaccagcaag

SEQ ID NO: 274 - protein, 206 aa, Zea mays
  GRMZM2G143718_T01 (B-boxes 5-42, 56-91)
MRTICDVCESAPAVLFCAADEAALCRPCDEKVHMCNKLASRHVRVGLADPNKLVRCDICENSPAFFYCEIDGTSLCLSCDMTVHVGGKRTHGRYLLLRQRVEFPGDKPGHMDDVPMEIQDPENQRDQKKPPKEQTANHHNGDDPATDGNCDDQGNIDSKMIDLNMRPVRTHGQESNSQTQGVGLSVNNHDSPGVVPTSNSERDTSK

SEQ ID NO: 275 - DNA, 615 bp, Zea mays
  GRMZM2G422644_T01
atgcggacgatctgcgatgtgtgcgagagcgcaccggcggtgctcttctgtgcggccgacgaggctgcgctttgccggccttgcgacgagaaggtacacatgtgcaacaagcttgctagtcggcatgtgagagttgggcttgcagaccctaataaactggcacgttgtgatatatgcgagaattcacctgctttcttctactgtgagatagatggcacctcactttgcctgagctgtgatatgactgttcatgttggtggcaaaagaacccatggtagatacctgctcctaaggcaaagggttgaatttccaggagataaaccgggccatatggatgacgtgcctatggagatcaaagatcctgaaaaccagagagagcaaaacacgcccaaggagcaaatggcaaaccaccataacgtcaatgatccagtctctgatggcaattgcgatggccagggtaacattgattcgaaaatgatcgatcttaatatgcgcccggctcgtactcatgggcaaggatcaaattcccagactcagggggtggatcttagtgtgaacaaccatgactctccaggggtggtgccaacaagtaattccgaaagagacgccatcaag

SEQ ID NO: 276 - protein, 205 aa, Zea mays
  GRMZM2G422644_T01 (B-boxes 5-42, 56-91)
MRTICDVCESAPAVLFCAADEAALCRPCDEKVHMCNKLASRHVRVGLADPNKLARCDICENSPAFFYCEIDGTSLCLSCDMTVHVGGKRTHGRYLLLRQRVEFPGDKPGHMDDVPMEIKDPENQREQNTPKEQMANHHNVNDPVSDGNCDGQGNIDSKMIDLNMRPARTHGQGSNSQTQGVDLSVNNHDSPGVVPTSNSERDAIK

SEQ ID NO: 277 - DNA, 516 bp, Arabidopsis thaliana
  AT2G21320.1
atgcgaattttgtgtgatgcttgtgagagcgccgccgctatcgtcttttgcgccgccgacgaagctgccctctgttgctcctgcgacgaaaaagttcataagtgcaacaagctggctagtcggcatcttcgtgtaggcttagctgatccgagtaatgcaccaagctgtgacatatgcgaaaatgcacccgcattcttttactgtgagatagatggtagttccctttgtctacaatgtgatatggtggtacatgttggtgggaagagaacacataggcggtttctattactgagacagagaattgagtttccaggcgataagcctaatcatgctgaccaactgggactacggtgtcaaaaggcttcctctggtcgtggtcaagaatcaaatgggaatggtgatcatgatcataatatgatcgatcttaactccaatcctcaaagagtacacgagcctggatcacataaccaagaggagggtattgatgtaaataacgcaaacaatcacgagcatgaa

SEQ ID NO: 278 - protein, 172 aa, Arabidopsis thaliana
  AT2G21320.1 (BBX18, G1881, B-boxes 5-42, 56-91)
MRILCDACESAAAIVFCAADEAALCCSCDEKVHKCNKLASRHLRVGLADPSNAPSCDICENAPAFFYCEIDGSSLCLQCDMVVHVGGKRTHRRFLLLRQRIEFPGDKPNHADQLGLRCQKASSGRGQESNGNGDHDHNMIDLNSNPQRVHEPGSHNQEEGIDVNNANNHEHE

SEQ ID NO: 279 - DNA, 549 bp, Arabidopsis thaliana
  AT4G38960.1
atgcggattttgtgcgatgcttgcgagaacgcagccgcaatcatcttttgcgccgccgatgaagctgccctttgtcgcccctgcgatgaaaaagttcatatgtgcaacaagctagctagtcggcatgtacgtgttggtttagctgaaccaagcaatgccccatgctgtgatatatgcgaaaatgcacctgccttcttttactgtgagatagacggtagttctctttgtctgcaatgtgacatggtagtacatgttggtggcaagagaacacacggtcggtttcttttgctgagacagagaatcgagtttccaggggataagcctaaagaaaacaatacgagggacaatttgcagaaccaaagagtctctacaaatggaaatggtgaagccaatgggaagattgatgacgaaatgattgatctaaatgctaatccacaaagagtacatgagccatcatcaaataacaacgggattgatgtaaataacgagaacaatcacgagcctgcaggccttgtaccagttggaccctttaaacgagagtctgagaag

SEQ ID NO: 280 - protein, 183 aa, Arabidopsis thaliana
  AT4G38960.1 (B-boxes 5-42, 56-91)
MRILCDACENAAAIIFCAADEAALCRPCDEKVHMCNKLASRHVRVGLAEPSNAPCCDICENAPAFFYCEIDGSSLCLQCDMVVHVGGKRTHGRFLLLRQRIEFPGDKPKENNTRDNLQNQRVSTNGNGEANGKIDDEMIDLNANPQRVHEPSSNNNGIDVNNENNHEPAGLVPVGPFKRESEK

SEQ ID NO: 281 - DNA, 555 bp, Eucalyptus grandis
  Eucgr.I02368.1
atgcggaccctttgtgacgcctgcgagagcgctgccgcggtcgtcttctgcgccgccgacgaggctgctctatgcagtgcctgcgacgacaaggtgcacatgtgtaataagctagctagtcggcacgtcagggttggccttgcgagtcccagcgatgttcctcgctgtgatatatgcgaaaatgcacctgctttcttctattgtgaggtagatggaacctcgctttgtctgcaatgcgatatgattgttcatgttggaggcaaaagaacgcatggaagataccttctattaaggcagagagttgagtttccggggcataaatctgcacacagtgatgaccaggctttgccattggtggatcaaaatgacaaacgagtgcaaaatcagggccctatagttatatcaggggagaatcatcaaaaccatagaccatccagtgttgaggtgcctgatgctgatgctgatgctgatgggcatggcaagatggattcaaaaatgattgatctgaatatgaaaccccatagaatgcacgaccaagcttcctataatgagcaa

SEQ ID NO: 282 - protein, 185 aa, Eucalyptus grandis
  Eucgr.I02368.1 (B-boxes 5-42, 56-91)
MRTLCDACESAAAVVFCAADEAALCSACDDKVHMCNKLASRHVRVGLASPSDVPRCDICENAPAFFYCEVDGTSLCLQCDMIVHVGGKRTHGRYLLLRQRVEFPGHKSAHSDDQALPLVDQNDKRVQNQGPIVISGENHQNHRPSSVEVPDADADADGHGKMDSKMIDLNMKPHRMHDQASYNEQ

SEQ ID NO: 283 - DNA, 552 bp, Glycine max
  Glyma01g37370.1
atgcgaacgctttgtgatgcttgtgagagcgccgcggctatagttttctgcgccgctgatgaggctgcactttgtcgtgcctgtgatgagaaggttcacatgtgcaacaagctagctagtaggcatgtgagggttggtcttgctagtccaagtgatgtaccacggtgtgacatatgtgagaatgcacctgctttcttctattgcgagacagatggaagttccctttgtttgcagtgtgatatgattgttcatgttggaggtaaaagaacgcatggaagatatcttctgttcaggcaaagagttgagtttccaggagataaatctagtcatgctgaaaatccggcttcacaaccattggaaccaggtgaggctaaaagaggacaaaatccacttcccaaactaaaaatgggagagaagcaacaaaatcacaagatgcctatggttccaacgccaggacctgatgctgatgggcatgccaagatggaaagtaaaatgattgatttgaacatgaagcctaatagaatacatgaacaagcatcaaataatcagcca

SEQ ID NO: 284 - protein, 184 aa, Glycine max
  Glyma01g37370.1 (B-boxes 5-42, 56-91)
MRTLCDACESAAAIVFCAADEAALCRACDEKVHMCNKLASRHVRVGLASPSDVPRCDICENAPAFFYCETDGSSLCLQCDMIVHVGGKRTHGRYLLFRQRVEFPGDKSSHAENPASQPLEPGEAKRGQNPLPKLKMGEKQQNHKMPMVPTPGPDADGHAKMESKMIDLNMKPNRIHEQASNNQP

SEQ ID NO: 285 - DNA, 579 bp, Glycine max
  Glyma11g07930.1
atgcgaacgctttgtgatgcttgtgagagtgcggcggctatagttttctgcgccgctgatgaggctgcactttgtcgtgcctgtgatgagaaggttcacatgtgcaataagctagctagtaggcatgtgagggttggtcttgcaagtccaagtgatgtgccacggtgtgacatatgtgagaatgcaccagctttcttctattgcgagacagatggaagttccctttgtttgcagtgtgatatgattgttcatgttggtggtaaaagaacgcatggaagatatcttctgttcaggcaaagagttgagtttccaggagataaatctagtcatgctgaaaatccggcttcacaagcattggaaccaggtgaggctaaaagaggacaaaatccacttcccaagctaaaaatgggagagaaacaacaaaatcacaggatgcctatggttccaacaccaggacctgatgctgatgggcaaaccaagatggaaactaaaatgattgatttgaacatgaagcctaatagaatacatgaacaagcatcaaataaccagtgcagttggatgaaagtagaaccctttcca

SEQ ID NO: 286 - protein, 193 aa, Glycine max
  Glyma11g07930.1 (B-boxes 5-42, 56-91)
MRTLCDACESAAAIVFCAADEAALCRACDEKVHMCNKLASRHVRVGLASPSDVPRCDICENAPAFFYCETDGSSLCLQCDMIVHVGGKRTHGRYLLFRQRVEFPGDKSSHAENPASQALEPGEAKRGQNPLPKLKMGEKQQNHRMPMVPTPGPDADGQTKMETKMIDLNMKPNRIHEQASNNQCSWMKVEPFP

SEQ ID NO: 287 - DNA, 552 bp, Populus trichocarpa
  POPTR_0005s11900.1
atgcgtaccctttgtgacgcttgtgaaagtgcttttgctattgttttctgtgctgctgatgaggccgcactttgccttgcctgcgataagaaggttcatatgtgcaacaaacttgcgagcaggcatgttcgagtgggtctggcgaatcccagtgaagttcctcgttgtgatatatgtgaaaatgcacctgctttcttctactgtgagacagatggaagttccctttgcttgcaatgtgatatgactgttcatgttggaggtaaaagaacacacgggagatatcttctgttgagacaaaaaattgagtttccagggaatcaacctcagcctgaggacccagcaccgcaacctatgtatccaggggagacaagaagaggacagaatcgaccacaaaaggcaacatcaggagagaacagacagaatcgccaagcttctccagttctgatgtcggtcactaattctgatgggcatgacaaggtggataagaatatgattgatttgaatatgaagcctcatcgaattcatgaacatgcttcaaataatcaggaacaa

SEQ ID NO: 288 - protein, 184 aa, Populus trichocarpa
  POPTR_0005s11900.1 (B-boxes 5-42, 56-91)
MRTLCDACESAFAIVFCAADEAALCLACDKKVHMCNKLASRHVRVGLANPSEVPRCDICENAPAFFYCETDGSSLCLQCDMTVHVGGKRTHGRYLLLRQKIEFPGNQPQPEDPAPQPMYPGETRRGQNRPQKATSGENRQNRQASPVLMSVTNSDGHDKVDKNMIDLNMKPHRIHEHASNNQEQ

SEQ ID NO: 289 - DNA, 555 bp, Populus trichocarpa
  POPTR_0007s13830.1
atgcgtaccctttgcgacgcctgtgagagtgctgctgctattgtcttctgtgctgctgatgaggctgcactttgccttgcctgcgatgagaaggttcatatgtgcaacaaacttgctagcaggcatgtgcgagtgggtctggcaaatcccagtgacgttccacgctgtgacatatgtgaaaatgcacctgctttcttttattgtgagacagatggaagttccctttgcttgcaatgtgatatgactgttcatgttggaggtaaaaggacacatgggagatatcttttgttgagacaaagagttgagtttccaggggataaacctcagcctgatgacctacattcgcaacctatgcatccaggggagacaaggaaaggacagaatcagccaccaaaggcaacagcagaagagaagcgacagaatcgccaggtttctccagctccaatgtcactctctaattctgatggacatgacaaagtggataaaaagatgattgatttgaatatgaagcctcaacgaactgatcacgaacaagcttctaataatcaggaactg

SEQ ID NO: 290 - protein, 185 aa, Populus trichocarpa
  POPTR_0007s13830.1 (B-boxes 5-42, 56-91)
MRTLCDACESAAAIVFCAADEAALCLACDEKVHMCNKLASRHVRVGLANPSDVPRCDICENAPAFFYCETDGSSLCLQCDMTVHVGGKRTHGRYLLLRQRVEFPGDKPQPDDLHSQPMHPGETRKGQNQPPKATAEEKRQNRQVSPAPMSLSNSDGHDKVDKKMIDLNMKPQRTDHEQASNNQEL

SEQ ID NO: 291 - DNA, 552 bp, Vitis vinifera
  GSVIVT01018818001
atgcgaacactttgtgacgtctgtgagagcgccgctgctattctcttttgcgctgccgatgaggctgctctgtgccgagtctgcgacgagaaggtccacatgtgtaataagcttgctagcaggcatgtgagggtagggcttgctgaccccagtgatgttccccggtgtgacatatgtgaaaatgcaccagcattcttttactgtgagatagatggaacttccctttgtttgcaatgtgatatgattgtacatgttggaggtaaaagaactcatggaagatatctcctcttgaggcagagagttgagtttccaggagataaatctgggaatcttgaggacccagccttgctaccaatggaaccaggtgagaacaggagaggacaaaatcagtcatctaaaccaacagtggtagaaaaccagcaaaatcgcagagtctctcctgttcccacaatggatgctaatgctgatgggcatgccaaaatggacactaaattgattgatttgaatatgaagccacaccgaatacatggacaagcttcaaacaatcagcat

SEQ ID NO: 292 - protein, 184 aa, Vitis vinifera
  GSVIVT01018818001 (B-boxes 5-42, 56-91)
MRTLCDVCESAAAILFCAADEAALCRVCDEKVHMCNKLASRHVRVGLADPSDVPRCDICENAPAFFYCEIDGTSLCLQCDMIVHVGGKRTHGRYLLLRQRVEFPGDKSGNLEDPALLPMEPGENRRGQNQSSKPTVVENQQNRRVSPVPTMDANADGHAKMDTKLIDLNMKPHRIHGQASNNQH

SEQ ID NO: 293 - DNA, 633 bp, Eucalyptus grandis
  Eucgr.I01328.1
atgcggacgatctgcgacgtgtgcgagaatgctgccgcgatcttcttctgcgccgccgacgaggccgctctgtgccgcgcttgcgacgagaaggttcatctgtgcaacaagctggcgagtcggcatgtgcgcgtcgggctcgccgatcctagtgaggtccagcgttgcgatatatgtgagaatgcccccgccttcttttactgtgagatagatggtagttccctctgcctgcaatgcgacatgctcgtgcatgttggcggcaagagaacccatgggagatatctcttactgaggcagagagtcgagtttcctggggataaacctggtcgattagaatcgcaaacgcctaatcagaatgaggtgaagagggagaaagatcagccacataagcttgcaatgaaagaggtccagcagaatcacagggcatctccagtacctgtcggagatgctatttctagcggcgaaggcaagatgcaggacaaaatgattgatctcaattctcggcctcaaaggactaaagggcagacttcaatgaacgaggatatggacgtaacaaatggctctaatcttgaatctgccggtgttgttcctgttggatcatttgatagacagcctgagatgaagcaaagcaca

SEQ ID NO: 294 - protein, 211 aa, Eucalyptus grandis
  Eucgr.I01328.1 (B-boxes 5-42, 56-91)
MRTICDVCENAAAIFFCAADEAALCRACDEKVHLCNKLASRHVRVGLADPSEVQRCDICENAPAFFYCEIDGSSLCLQCDMLVHVGGKRTHGRYLLLRQRVEFPGDKPGRLESQTPNQNEVKREKDQPHKLAMKEVQQNHRASPVPVGDAISSGEGKMQDKMIDLNSRPQRTKGQTSMNEDMDVTNGSNLESAGVVPVGSFDRQPEMKQST

SEQ ID NO: 295 - DNA, 609 bp, Populus trichocarpa
  POPTR_0004s16950.1
atgcgaatgctttgtgatgtgtgtgaaagcgcagctgcgattcttttctgtgctgctgatgaagccgcgctttgccgctcctgcgacgagaaggttcatatgtgtaacaagctagctagtcggcatgtacgagtaggacttgcagatcctagtgatgttccacagtgtgacatatgtgaaaaggcaccagctttcttttactgcgagatagatggcagttcgctctgcttgcaatgtgatatgatagtgcatgttggtggtaaaaggacccatgggagatatctcctgttgaggcagagagttgagtttccaggggataaacctggctgtacagaggaacaaggacagcaaccgcttgatgataatgaaacaagaagggaccaaaatcagccgcctaagctcacagctagagaaaatcaacagaaccacagggcctctccagttccaatggtagagaataacactgatagtgacgggaaaatggacaacaaattgattgatcttaatgccaggcctcagcgtgtacatgggaaaaatccaactaaccaggaaaaccatgaatcctctagtttggctccttttggattctttaaaggggagccacaaaag

SEQ ID NO: 296 - protein, 203 aa, Populus trichocarpa
  (B-boxes 5-42, 56-91)
MRMLCDVCESAAAILFCAADEAALCRSCDEKVHMCNKLASRHVRVGLADPSDVPQCDICEKAPAFFYCEIDGSSLCLQCDMIVHVGGKRTHGRYLLLRQRVEFPGDKPGCTEEQGQQPLDDNETRRDQNQPPKLTARENQQNHRASPVPMVENNTDSDGKMDNKLIDLNARPQRVHGKNPTNQENHESSSLAPFGFFKGEPQK

SEQ ID NO: 297 - DNA, 609 bp, Populus trichocarpa
  POPTR_0009s12730.1
atgcgaacgatttgtgacgtgtgtgagagcgcagccgcgattcttttttgtgcagctgatgaagccgctctttgccgttcctgtgacgagaaggttcatttgtgcaacaagctagctagtcggcacgtgcgagtaggacttgcagatcctagcgctgttccacagtgtgacatatgtgaaaatgcaccagctttcttttactgtgagatagatggtagttcgctctgcttgcaatgcgatatgatagtacatgttggtggtaaaagaacccatggtagatatctcctgttgaggcagagggttgagtttccaggggataaacctggccggatggaggagcaaggacaacaacctcttgatcataatgaaacaaggagggaccaaaaccagccacttaaactcacagctagagaaaataaacaaaaccacagagcctctccagttccaatggtagagaataacacagatagcgacggaaaaatggacaacaatttgattgatcttaatgccaggcctcagcggatacatggacaaaattcaactaaccaggaaaatcacgaatcttctagtgcggttcctgttggatccttcaaaagagagcctcaaaag

SEQ ID NO: 298 - protein, 203 aa, Populus trichocarpa
  POPTR_0009s12730.1 (B-boxes 5-42, 56-91)
MRTICDVCESAAAILFCAADEAALCRSCDEKVHLCNKLASRHVRVGLADPSAVPQCDICENAPAFFYCEIDGSSLCLQCDMIVHVGGKRTHGRYLLLRQRVEFPGDKPGRMEEQGQQPLDHNETRRDQNQPLKLTARENKQNHRASPVPMVENNTDSDGKMDNNLIDLNARPQRIHGQNSTNQENHESSSAVPVGSFKREPQK

SEQ ID NO: 299 - DNA, 630 bp, Vitis vinifera
  GSVIVT01024173001
atgcgaactctttgtgatgcttgcgagagcgcagcagctatcctgttctgcgccgcagacgaggccgccctctgccgtgcctgcgacgaaaaggtccatatgtgtaacaaacttgctagtcggcatgtaagagttgggctggctgacccaagtgatgttcctcgatgtgatatatgtgaaaatgcacctgctttcttttattgtgaagtcgatggaacttctctttgcctgcaatgtgatatgattgtacatgttggaggtaaaagaacccatggaagatatctgctattaaggcagagagttgagtttccaggggataagcctggccgtcttgaggaactaaggttacaatctggtgagcctggtgaagcaagaagggaacagaattggccacctatgatgacattgagagagacccagccaaatcacatggcctcttctgttccaatgttagagaataacactcatggtgatggcaagatggacaataaattgattgatctgaatgctcggccccaaagagtacatgggcaaacttcaaataaccagagtatggatgtacatagtggcactaatcatgaatctgaaagtgtagttcctgttggatccttcaaaagagagcctgaaaag

SEQ ID NO: 300 - protein, 210 aa, Vitis vinifera
  GSVIVT01024173001 (B-boxes 5-42, 56-91)
MRTLCDACESAAAILFCAADEAALCRACDEKVHMCNKLASRHVRVGLADPSDVPRCDICENAPAFFYCEVDGTSLCLQCDMIVHVGGKRTHGRYLLLRQRVEFPGDKPGRLEELRLQSGEPGEARREQNWPPMMTLRETQPNHMASSVPMLENNTHGDGKMDNKLIDLNARPQRVHGQTSNNQSMDVHSGTNHESESVVPVGSFKREPEK

SEQ ID NO: 301 - DNA, 723 bp, Solanum lycopersicum
  Solyc01g110370.2.1
atgagaaccctttgtgatgtttgtgaaagtgctgcggcaatacttttctgtgctgctgatgaggctgctctctgccgttcttgtgacgaaaaggtacatttgtgcaacaagcttgcaagtcgacatgtaagagttgggctagctgaccccagtaaaatccagcgttgcgacatatgcgaaaatgcacctgctttcttttattgtgagatcgatggaagttccctttgtttgcaatgtgatatgattgtccatgttggaggtaaacgaacccatggaagatatctccttataaggcagaggattgagtttccgggggataaattgggcccttcaaatgagcaaggattgccatctactgaacaaggtgatgtaaggagggagactgcacagccctttaaactccctatgatagacaatcaccaaccaaacagggagactgctatgacagcagtagaaaataacgtgaataatagcgtaaaagtggagaatgagttgattgaccttaactccagacctcaaaggatgcatggtcaaacgtcaaataatcaggaacaagtaatggacatgcttggtggtagcaatcatgagtctgtcggcgtggttcctgatgggcccttcaaaagagaaccagagaaatgtgagctgctgccattccaaatttcaaacttgaattatgaattggagttgccggccccagctgagttctatgcaatgtcaaagctt

SEQ ID NO: 302 - protein, 241 aa, Solanum lycopersicum
  Solyc01g110370.2.1
MRTLCDVCESAAAILFCAADEAALCRSCDEKVHLCNKLASRHVRVGLADPSKIQRCDICENAPAFFYCEIDGSSLCLQCDMIVHVGGKRTHGRYLLIRQRIEFPGDKLGPSNEQGLPSTEQGDVRRETAQPFKLPMIDNHQPNRETAMTAVENNVNNSVKVENELIDLNSRPQRMHGQTSNNQEQVMDMLGGSNHESVGVVPDGPFKREPEKCELLPFQISNLNYELELPAPAEFYAMSKL

SEQ ID NO: 303 - DNA, 636 bp, Glycine max
  Glyma11g11850.1
atgcgaaccctttgcgacgtatgcgagagcgccgctgccattctcttctgcgccgctgatgaggccgctctctgctccgcttgtgaccacaagatccatatgtgtaacaaacttgctagtaggcatgttcgagttggccttgctgaccccactgatgttccacgctgtgacatatgtgaaaatgcacctgctttcttttactgtgagatagatggtagttcgctgtgtctgcaatgtgatatgattgtgcatgttggtggtaaaagaacccatggaagatatcttctattgaggcaaagagctcagtttccaggtgataaacctgcccaaatggaagaactagagctgcaacctatggatcaaaatgaatcgagaagggatgaaagtcagtcactcaagctaaaaacaagagatagtcagcagaatcacagtgtctcaccttttccaaggcaagaaaataatattgatggtcatggaaaaatggataaaaagttaattgatcttaataccaggccactgcggttaaatggatcagcaccaaacaaccaggaacaatgcatggatattttaagaggcaataatcatgaatctgccagtgtgccaccagtagaatccttcaaacaagagtctgagaag

SEQ ID NO: 304 - protein, 212 aa, Glycine max
  Glyma11g11850.1 (B-boxes 5-42, 56-91)
MRTLCDVCESAAAILFCAADEAALCSACDHKIHMCNKLASRHVRVGLADPTDVPRCDICENAPAFFYCEIDGSSLCLQCDMIVHVGGKRTHGRYLLLRQRAQFPGDKPAQMEELELQPMDQNESRRDESQSLKLKTRDSQQNHSVSPFPRQENNIDGHGKMDKKLIDLNTRPLRLNGSAPNNQEQCMDILRGNNHESASVPPVESFKQESEK

SEQ ID NO: 305 - DNA, 537 bp, Glycine max
  Glyma12g04130.1
atgcgaaccctttgcgacgtatgcgagagcgccgctgccattgtcttctgcgccgctgatgaggctgctctctgctccgcttgtgaccacaagatccatatgtgtaacaaacttgctagtagacacgttcgggttggccttgctgaccccactgatgttccacgctgtgacatatgtgaaaacgcacctgctttcttttactgtgagatagatggtagttcgctgtgtctgcaatgtgatatgattgtgcatgttggtggtaaaagaactcatggaagatatcttctattgaggcaaagagttcagtttccatatagtcagcagaatcacagtgtctcacctgttccaagacaagaaaataatattgatggtcatggaaaaatggataaaaagttaattgatcttaatacgaggccactgcggttaaatggagcagcaccaaacaaccaggaacgaggtatggatattttaagaggcaataatcataaatctgcgagtgtgccaccagtagaatccttcaaacaagagtctgagaag

SEQ ID NO: 306 - protein, 179 aa, Glycine max
  Glyma12g04130.1 (B-boxes 5-42, 56-91)
MRTLCDVCESAAAIVFCAADEAALCSACDHKIHMCNKLASRHVRVGLADPTDVPRCDICENAPAFFYCEIDGSSLCLQCDMIVHVGGKRTHGRYLLLRQRVQFPYSQQNHSVSPVPRQENNIDGHGKMDKKLIDLNTRPLRLNGAAPNNQERGMDILRGNNHKSASVPPVESFKQESEK

SEQ ID NO: 307 - DNA, 960 bp, Brachypodium distachyon
  Bradi1g35990.1
atgcgccgcccctcgccgccgcccgcagccgggggcgagatccaggccctggcagtggcgcccgcctccgctgcgggctcctcctcctccaccaccaccaccggcggcggcggctccttcacggcgctcctggggctcccgatgtcccaggccatggagctcctgctcccgccgtccgctccgccgcctcccaccttcccgtccgaccccagcctcgtcgaccgcgccgcgcgcttctccgccttcgcgtcctctaattccccgtcccccacccctcctccccctccccccgccgccaagcgcaaggccgaccacgccgccgaccgcgcctccaaggggaagaaggggaagacgacggccggcggcagcgacgagaaggacgcgggcggcggcgaggatgagaagccggcgtacgtgcacgtcagggccaggaggggccaggccacggatagccatagcctcgccgagcgggcgagacgcgagaagataaatgcgaggatggagctgctcaaggagctggtccccggatgcagcaaggtatcaggaacagcgctggtactggatgagatcatcaatcatgttcaatctcttcaaagacaagttgagtacttatcaatgagactagcagcagtaaacccgagggttgacttcggtgggcttgacagctttttgacttccgagtgtggaagaataacaggtttgaactgtaagagtggaatggacttggagcaggtcacctggcctgacatgggcgtccatggagcaaggcatcttatgcaactacaacaacagttttggcatggtgatttagcacatccacaccaaccgccatcacagtgggaaaagcggggggatgttaatcctcctgtctttagccactccagttcctccctctttggctatgatctcgcaagctctggtcaacagcaacctcagccaaacaagctaaagacagagctg

SEQ ID NO: 308 - protein, 320 aa, Brachypodium distachyon
  Bradi1g35990.1 (bHLH domain 145-202)
MRRPSPPPAAGGEIQALAVAPASAAGSSSSTTTTGGGGSFTALLGLPMSQAMELLLPPSAPPPPTFPSDPSLVDRAARFSAFASSNSPSPTPPPPPPAAKRKADHAADRASKGKKGKTTAGGSDEKDAGGGEDEKPAYVHVRARRGQATDSHSLAERARREKINARMELLKELVPGCSKVSGTALVLDEIINHVQSLQRQVEYLSMRLAAVNPRVDFGGLDSFLTSECGRITGLNCKSGMDLEQVTWPDMGVHGARHLMQLQQQFWHGDLAHPHQPPSQWEKRGDVNPPVFSHSSSSLFGYDLASSGQQQPQPNKLKTEL

SEQ ID NO: 309 - DNA, 1110 bp, Zea mays
  GRMZM2G074438_T01
atgcgccacgcctcgccaccgcaggagctccccgccgccgggcgcgagatccaggcggcgctggcccccgccaacggcaacgccgcgggcgcccgcgggggcggaggctccttcacggcgctgctgggactccccactccgcaggccatggagctgctcctcccccgcacgacgccgcccgccctagccctagccccagccgcagcgcccgcgcccacgcccaccttcccctccgacccgcacctcgtggaccgcgccgggcgcttctccacgttcgcgcccccgtcgccgccctccccatccccaacgcagcagcctccaccgccccctcccgccgccgtcgccggcaagcgcaaggccgaccccgtcgaccgcgcctccaaggggaaggcggcgaagaaggggaagacggcggaggagaagcccgcggccgccggcggcgaggacgagaagccggcgtacgtgcacgtgcgggccaggcggggccaggccacggacagccacagcctcgccgagcgggcgagacgcgagaagatcaatgcgaggatggagctgctcaaggagctggtccccggctgcagtaaggtatcaggaacagcgttggtgctagatgagatcatcaatcatgttcagtctctccaaaggcaagttgagtacttgtcaatgaggcttgcaactgtaaacccgaggggcgattttggtgggctagatagctttctgaccacggagtgtggaaggatagcaagcttcaactgcaagaacggaatcgacttggagcaggtaacctggccagaaatgggtgttcatggagcaaggcagctgatgcaactccaacagcagttctggcatggtgatttggcgcatccacaccaagtggcttcacagtgggaaaagcggggggatggccatcctcccgtcttcagcaactccagtccctctctcttcggctatgatctaacaagctctggtaaaccttgcacgcagtcctatatcaccttcctgaatgaatttagttgtttgtcgcttacttcacatatcacagcctggcttgccccacaacttttgtctcttagtttgtcccgccagtgctctcttgagaacaaagtgtac

SEQ ID NO: 310 - protein, 370 aa, Zea mays
  GRMZM2G074438_T01 (bHLH domain 161-218)
MRHASPPQELPAAGREIQAALAPANGNAAGARGGGGSFTALLGLPTPQAMELLLPRTTPPALALAPAAAPAPTPTFPSDPHLVDRAGRFSTFAPPSPPSPSPTQQPPPPPPAAVAGKRKADPVDRASKGKAAKKGKTAEEKPAAAGGEDEKPAYVHVRARRGQATDSHSLAERARREKINARMELLKELVPGCSKVSGTALVLDEIINHVQSLQRQVEYLSMRLATVNPRGDFGGLDSFLTTECGRIASFNCKNGIDLEQVTWPEMGVHGARQLMQLQQQFWHGDLAHPHQVASQWEKRGDGHPPVFSNSSPSLFGYDLTSSGKPCTQSYITFLNEFSCLSLTSHITAWLAPQLLSLSLSRQCSLENKVY

SEQ ID NO: 311 - DNA, 1077 bp, Zea mays
  GRMZM2G378653_T01
atggcgccactctcccctacccccgcctccgcctctgctcccgtgtcctcctcccctcgttccctcgtcccggacgcctccgccgcgccgatgcgccccgcctcgccgccgcaggagctccccgccgccgggggcgagatccaggcggcgctggcccctgccaatgcctccaccgcgggcgcccgcggaggcggaggctccttcacggcgctgctgggactccccacctcgcaggccatggagctgctcctcccccgcacgacgccccccgccctagccacagcgcccgcgccaaccttcccctccgacccgcacctcgtggaccgcgccgcgcgcttatccacgttcgcgcccccgtccccgtccccatcctccacgtccccggcccggcccctccccgccgccgctaacgccggcaagcgcaaggccgaccccgtcgaccgtgcctccaaggggaaggcggcgaagaaggggaagacggcggaggagaagctcgcgggcggcgacggcgacgacgagaagccggcgtacgtgcacgtgcgggccaggcggggccaggccacggacagccacagcctcgccgagcgggcgagacgcgagaagatcaatgcgaggatggagctgctcaaggagctggtccccggctgcagtaaggtatcaggaacagcattggtgctagatgagatcatcaatcatgttcagtctctccaaaggcaagttgagtacttgtcaatgaggctcgcagctgtaaacccaagggtcgattttggtgggctagacagctttctgaccacagagtgtggaaggatagcaggcttcaactgcaagaacggaatcgacttggagcaggtaacctggccagaaatgggtgttcatggagcaaggcagctgatgcaacttcaacagcagttctggcatggcgatttaacacatccacaccaagtggcttcacagtgggaaaagcgtggggatggccatcctcccgtctttagcaactccagtccctctctcttcggctatgatctaacaagctctggagcccagcaaaccccggcgagcaagctaaagacggagctt

SEQ ID NO: 312 - protein, 359 aa, Zea mays
  GRMZM2G378653_T01 (bHLH domain 184-241)
MAPLSPTPASASAPVSSSPRSLVPDASAAPMRPASPPQELPAAGGEIQAALAPANASTAGARGGGGSFTALLGLPTSQAMELLLPRTTPPALATAPAPTFPSDPHLVDRAARLSTFAPPSPSPSSTSPARPLPAAANAGKRKADPVDRASKGKAAKKGKTAEEKLAGGDGDDEKPAYVHVRARRGQATDSHSLAERARREKINARMELLKELVPGCSKVSGTALVLDEIINHVQSLQRQVEYLSMRLAAVNPRVDFGGLDSFLTTECGRIAGFNCKNGIDLEQVTWPEMGVHGARQLMQLQQQFWHGDLTHPHQVASQWEKRGDGHPPVFSNSSPSLFGYDLTSSGAQQTPASKLKTEL

SEQ ID NO: 313 - DNA, 1056 bp, Setaria italica
  Si006781m
atgcgacaccgcttgccactgccaccggagctccccgccgccgggggcgagatccaggcagcgctgattcccgccgccgcgccggccacagggcccgccgtctccgcttcatccgccgccggcagaggaggaggcgggggctccttcacggcgctgctggggctccccacctcccaggccatggagctgctcctcccccgcgcggcggcggcgccgcccgctcccgctcccgcacccgcgcccgcgcccaccttcccttccgacccgcacctcgtggaccgcgccgcgcgcttctccgcgttcgcgtccccgtccccgtcctccccgtccccaaccccgcctccgcccccgcccccggcccctcccgccgccgccgccgccgctaacgccggcaagcgcaaggccgaccaacccgccgaccgcgcctccaaggggaagtcagcgaagaaggggaagacggcggaggagaagcccgcgggcggcgacggcgaggacgagaagccggcgtacgtgcacgtgcgggccaggcggggccaggccacggatagccacagcctcgccgagcgggcgagacgcgagaagatcaatgcgaggatggagctgctcaaggagctggtccccggctgcagcaaggtatcaggaacagcgctggtgctggatgagatcattaatcatgttcagtctctccaaaggcaagttgagtacttgtcaatgaggctcgcagctgtaaacccaagggtcgactttggtgggctagacagctttctgaccacagagtgtggaagaatagcaggcttgaactgcaagaatggaatcgacttggagcaggtcacctggccagaaatgggtgttcatggagcaaggcatctgatgcaacttcaacagcagttctggcatggtgatttagcgcatccacaccaagcgccatcacagtgggaaaagcgaggggatggacatcctcccgtctttagcagctccagcccttctctcttcggctacgatctaacaagctctggagcacaacaacccccggcgagcaagctaaagacagagctg

SEQ ID NO: 314 - protein, 352 aa, Setaria italica
  Si006781m (bHLH domain 177-234)
MRHRLPLPPELPAAGGEIQAALIPAAAPATGPAVSASSAAGRGGGGGSFTALLGLPTSQAMELLLPRAAAAPPAPAPAPAPAPTFPSDPHLVDRAARFSAFASPSPSSPSPTPPPPPPPAPPAAAAAANAGKRKADQPADRASKGKSAKKGKTAEEKPAGGDGEDEKPAYVHVRARRGQATDSHSLAERARREKINARMELLKELVPGCSKVSGTALVLDEIINHVQSLQRQVEYLSMRLAAVNPRVDFGGLDSFLTTECGRIAGLNCKNGIDLEQVTWPEMGVHGARHLMQLQQQFWHGDLAHPHQAPSQWEKRGDGHPPVFSSSSPSLFGYDLTSSGAQQPPASKLKTEL

SEQ ID NO: 315 - DNA, 981 bp, Arabidopsis thaliana
  AT2G42300.1
atggatctgacccaaggtttcagagctagatccggcgttgttgggccggtggccggactagaatctctcaatttcagcgacgaatttcggcacttagtgacgacgatgcctccggagactactggcggctccttcacggctttactcgagatgcctgtgactcaggccatggagcttctccatttcccagattcatcgtcttctcaggccagaaccgttaccagtggtgatatttctcctaccactcttcaccctttcggggctttgacttttccttctaactcgcttctcttggaccgcgccgctcgtttctcggtgattgctacagagcaaaacggtaatttttccggcgagactgctaactctttaccttctaatcccggcgcgaatctggacagagtcaaagccgagcctgctgagaccgattcaatggtggagaatcagaaccagagctactcttctggaaaaaggaaagaacgcgagaagaaggtcaaaagctcgacgaagaagaacaagagctccgtggagtcagacaagttgccatatgttcatgtcagagctcgtcgtggtcaagctactgataaccatagcttagcagagagagcaagaagggagaagataaacgcacgaatgaagctgctacaggaactggtcccaggctgtgataagattcagggcactgcattggttctggatgaaatcattaaccatgtgcaaactttacagcgtcaagtggagatgctatctatgagacttgctgcagtaaaccccagaatcgacttcaatctagacagcatactggcttcagagaacggctctcttatggatggtagcttcaatgcagagtcttatcatcagctgcaacaatggcctttcgacggctaccaccagccggaatggggaagagaagaagatcatcatcaagccaatttctcaatgggttcagctactttacacccaaatcaggtgaaaatggagctc

SEQ ID NO: 316 - protein, 327 aa, Arabidopsis thaliana
  AT2G42300.1 (bHLH domain 189-246)
MDLTQGFRARSGVVGPVAGLESLNFSDEFRHLVTTMPPETTGGSFTALLEMPVTQAMELLHFPDSSSSQARTVTSGDISPTTLHPFGALTFPSNSLLLDRAARFSVIATEQNGNFSGETANSLPSNPGANLDRVKAEPAETDSMVENQNQSYSSGKRKEREKKVKSSTKKNKSSVESDKLPYVHVRARRGQATDNHSLAERARREKINARMKLLQELVPGCDKIQGTALVLDEIINHVQTLQRQVEMLSMRLAAVNPRIDFNLDSILASENGSLMDGSFNAESYHQLQQWPFDGYHQPEWGREEDHHQANFSMGSATLHPNQVKMEL

SEQ ID NO: 317 - DNA, 1137 bp, Arabidopsis thaliana
  AT3G57800.2
atggatctgactggaggatttggagctagatccggcggtgttggaccgtgccgggaaccaataggccttgaatcgctacatctcggtgacgaatttcggcaactagtgacgactttacctcccgagaaccccggcggttcgttcacggctttgcttgagcttccacctacacaagcagtggagcttctccatttcactgattcttcgtcttctcaacaagcggcagtgacagggatcggtggagagattcctccgccgcttcactctttcggtgggacattggcttttccttctaactcagttctcatggagcgagcagctcgtttctcggtgattgccactgagcaacaaaacggaaatatctccggggagactccgacgagctctgtaccttccaattcaagtgctaatctcgacagagtcaagacggagcctgctgagaccgattcatctcagcggttgatttctgattcagcgattgagaatcaaatcccttgccctaaccagaacaatcgaaatgggaagaggaaagatttcgaaaagaagggtaaaagctcgacgaagaagaacaaaagctctgaagagaacgagaagctgccatatgttcacgttagagctcgtcgtggtcaagcaaccgatagccatagcttagcagaacgagcaagaagagagaagataaatgcacgaatgaagctgttacaggaactggtcccaggctgtgataagattcaaggtaccgcgctggtgctggatgaaatcattaaccatgtccagtcattacaacgtcaagtggagatgctatcaatgagacttgctgcggtaaaccccagaatcgacttcaatctcgacaccatattggcttcagaaaacggttctttaatggatgggagcttcaatgccgcaccaatgcagcttgcttggcctcagcaagccattgagaccgaacagtcctttcatcaccggcaactgcaacaaccaccaacacaacaatggccttttgacggcttgaaccagccggtatggggaagagaagaggatcaagctcatggcaatgataacagcaatttgatggcagtttctgaaaatgtaatggtggcttctgctaatttgcacccaaatcaggtcaaaatggagctg

SEQ ID NO: 318 - protein, 379 aa, Arabidopsis thaliana
  AT3G57800.2 (bHLH60, G2144, bHLH domain 208-265)
MDLTGGFGARSGGVGPCREPIGLESLHLGDEFRQLVTTLPPENPGGSFTALLELPPTQAVELLHFTDSSSSQQAAVTGIGGEIPPPLHSFGGTLAFPSNSVLMERAARFSVIATEQQNGNISGETPTSSVPSNSSANLDRVKTEPAETDSSQRLISDSAIENQIPCPNQNNRNGKRKDFEKKGKSSTKKNKSSEENEKLPYVHVRARRGQATDSHSLAERARREKINARMKLLQELVPGCDKIQGTALVLDEIINHVQSLQRQVEMLSMRLAAVNPRIDFNLDTILASENGSLMDGSFNAAPMQLAWPQQAIETEQSFHHRQLQQPPTQQWPFDGLNQPVWGREEDQAHGNDNSNLMAVSENVMVASANLHPNQVKMEL

SEQ ID NO: 319 - DNA, 1137 bp, Eucalyptus grandis
  Eucgr.A02413.1
atggagccgtcatctctaaccctagccggatccaccgacgccgcgctggagtcggtcctcaccgaggaaatccgaagcctgatggctccccccccggagagcaccagttccttcacggccctcctcgagctcccccggacccgagccatcgagctcctccactcgccggaggcgcccaattccccgggcgtcgccgtccccggcggccccgcggggacgcccttgcgccgcctcggcggcgacggcgggggcggcttcgctttggccgtgggttccgacctcgcggcgaggtaccccgccttattcggagagaagaacgactccgtggagacgagctcgcagaaggtgaagagcgagccgttgacggaatcggactcgaaccccaactcgtcgccgcagccgctggtgtccgatccgacggtggagaacaaggggcagaggccgacgaagaggaaagaccgagagaagaaggcgaaagcgtcggcgaaaaagagcaagaacgagagctcggaagatgcggaggagcttccttacgtgcacgtccgagctcgtcgcggtcaagccaccgatagccatagcttagcagagagggcgagaagagagaaaataaatgctcggatgaagctgctgcaggagctcgtcccgggctgcagcaagatatctggtacagcttcggtgttggatgaaatcattaatcatgtgcaatctttacaacgccaagttgagcttctgtcaatgagacttgcggcagctaacccaagggtcgatttcaacatggataacaattttgcagaaaacatgtctctggtagacagtaatttccccagcatggttatgccgttcatgtggcctgaagttcaggttaatgaaagcagacagccgtaccatcagcaatggcagtttaattcacttccacagccagtttggggaagggaacaagacaatcataactttatcaccccagaaaattctctattgagttatgattctccggcaaattcagattttgaatattgcttagatagctggggagtcatacagttcagctatgagcaaattaacagaaagctggaagttcttgttgtagttttgtccttgcactctagagcaaccgaaaatggagctatgaaggtggat

SEQ ID NO: 320 - protein, 379 aa, Eucalyptus grandis
  Eucgr.A02413.1 (bHLH domain 185-242)
MEPSSLTLAGSTDAALESVLTEEIRSLMAPPPESTSSFTALLELPRTRAIELLHSPEAPNSPGVAVPGGPAGTPLRRLGGDGGGGFALAVGSDLAARYPALFGEKNDSVETSSQKVKSEPLTESDSNPNSSPQPLVSDPTVENKGQRPTKRKDREKKAKASAKKSKNESSEDAEELPYVHVRARRGQATDSHSLAERARREKINARMKLLQELVPGCSKISGTASVLDEIINHVQSLQRQVELLSMRLAAANPRVDFNMDNNFAENMSLVDSNFPSMVMPFMWPEVQVNESRQPYHQQWQFNSLPQPVWGREQDNHNFITPENSLLSYDSPANSDFEYCLDSWGVIQFSYEQINRKLEVLVVVLSLHSRATENGAMKVD

SEQ ID NO: 321 - DNA, 1200 bp, Glycine max
  Glyma03g29710.1
atggaccaagctccgggaggattgcgcggatccgtgcatgacggcgctacgctcgagtcaattcaattcaacgaagaaattcagggaatcatggcgccggtgccggcgccggaaaacgctaactcgttcaccgcgctgcttgaactcccgccgacgcaggcggtggagctccttcactcgccggaatccgacagcgctcggaaaccgcctaattgccacgtcagcgcgaaccagaaaccctacctgcccaactctttcggcagcaatttaaccttcccttccaacgccgccttaatcgaacgcgccgcgaagttctctgtgttcgccggcgagaactcgccgcttccgccggaggaggcgtgcctggttccggccgggaccggttccgtttcgaatttggatagagtgaagaacgagccacaggagaccgattcgaacccgtgctcgagctcgaggctgggttgcatttcggatcccgcggtggagaacaacaatcagaggaccgccaagagaaaggagcgagagaagaagctaacagttaaaggatcgtcgaagaagagtaaaagcatcgccgatgagacctccggtgacggcgagaagcttccttacgttcatgttcgagttcgtcgaggtcaagccactgatagccatagcttggcagaaagggctaggagagagaagatcaacgctcgcatgaagcttttgcaagagctggtcccaggctgcgacaagatatcagggacggcaatggttctggatgaaatcatcaaccatgtgcaatctctacagcgtcaagtggagatcttatcaatgaaactggcagcagttaaccctagaattgatttcagcctcgacagtttattggctactgatggggcatctctaatggataataacttacctagcatggtgacacctctcatgtggccagaaatcccactcaatggcaaccggcagcattatcaacagcagtggcaattggatgcattccaccaacctctctgggagagggaagaagtcaaccataatttcatgactccggaaaactcacttttgagttatgactcgtcggcaaactcagcggcagtgcagccggtttatattgttgtcttaccctcggatcccctcagttctactatgagacattgctttcttcgttggactaaagagtatggtgatcaaactctcgagttaactcgt

SEQ ID NO: 322 - protein, 400 aa, Glycine max
  Glyma03g29710.1 (bHLH domain 210-267)
MDQAPGGLRGSVHDGATLESIQFNEEIQGIMAPVPAPENANSFTALLELPPTQAVELLHSPESDSARKPPNCHVSANQKPYLPNSFGSNLTFPSNAALIERAAKFSVFAGENSPLPPEEACLVPAGTGSVSNLDRVKNEPQETDSNPCSSSRLGCISDPAVENNNQRTAKRKEREKKLTVKGSSKKSKSIADETSGDGEKLPYVHVRVRRGQATDSHSLAERARREKINARMKLLQELVPGCDKISGTAMVLDEIINHVQSLQRQVEILSMKLAAVNPRIDFSLDSLLATDGASLMDNNLPSMVTPLMWPEIPLNGNRQHYQQQWQLDAFHQPLWEREEVNHNFMTPENSLLSYDSSANSAAVQPVYIVVLPSDPLSSTMRHCFLRWTKEYGDQTLELTR

SEQ ID NO: 323 - DNA, 1098 bp, Glycine max
  Glyma19g32570.1
atggaccaagctccgggaggattgcgcggatccgttcaccacggcgccacgctcgagtcaattcaattcaacgaagaaattcagggactcatggcgccggcgccggaaaacgcgagctcgttcaccgcgctgcttgaactcccgccgacgcaggcggtggagctccttcactcgccggaatctgacagcgctcggaaaccgcctaattgccatgtcagcgcgaaccagaaaccctacctgctcaattctttcggcagcaatttgaccttcccttccaacgccgccttaatcgaacgcgccgcgaagttctccgtgttcgccggcgagaactcgccgcctccgccgggggaggcgcgcctgattccagcaggaaccggttcgactttggacagagtgaagaacgagccgcaagagaccgattcgaacccgtgctcgagctcgaggctgggttgcatttcggatcccgcggttgaaaacaacattcagaggaccgccaagagaaaggagcgagagaagaaggctaaaggatcgtcgaagaagcgtaagagcgccgccgatgagacatccggtgacggcgagaagcttccctacgtccatgttcgagttcgtcgaggtcaagccactgatagccatagcttggcagaaagggctaggagagagaagatcaatgctcgcatgaagcttttgcaagagctggtcccaggctgcgacaagatatcaggaacggcaatggttctggatgaaatcatcaaccatgtgcaatctctacagcgtcaagtggagatcttatcaatgaaactggcagcagttaacccaagaatggatttcagcctcgacagtttattggctactgatggggcatctctagtggatagtaacttacctagcatggtgacacctctcatgtggccagaaatcccactcaatggcaaccggcagcattatcaacagcagtggcaattggatgcattccaccaaccgctatgggagagggaagaagtcaaccataatttcatgactccggaaaactcacttttgagttatgactcatcggcaaactcagcgtctctgcacttaaatcaattgaagatggagctc

SEQ ID NO: 324 - protein, 366 aa, Glycine max
  Glyma19g32570.1 (bHLH domain 204-261)
MDQAPGGLRGSVHHGATLESIQFNEEIQGLMAPAPENASSFTALLELPPTQAVELLHSPESDSARKPPNCHVSANQKPYLLNSFGSNLTFPSNAALIERAAKFSVFAGENSPPPPGEARLIPAGTGSTLDRVKNEPQETDSNPCSSSRLGCISDPAVENNIQRTAKRKEREKKAKGSSKKRKSAADETSGDGEKLPYVHVRVRRGQATDSHSLAERARREKINARMKLLQELVPGCDKISGTAMVLDEIINHVQSLQRQVEILSMKLAAVNPRMDFSLDSLLATDGASLVDSNLPSMVTPLMWPEIPLNGNRQHYQQQWQLDAFHQPLWEREEVNHNFMTPENSLLSYDSSANSASLHLNQLKMEL

SEQ ID NO: 325 - DNA, 1071 bp, Glycine max
  Glyma10g12210.1
atggagcaaaccactctcgaagccattcagttcaacgaggaaatccaaggcctcatggctgctccggcgccggaaaccgtcaattccttcaaggcgttgctcgagcttccgtcgacgcaggccgtcgagctcctccactcgcctgagcgcgccagaaaaccgctgcgccacagtccgaaacctccaacgccaccgccaccgcatccgccaacctcaccttccttcaccgcctccgcatccgccgccaccgccaacctcaccttcccctccaacgccgcactgatcgaacgcgccgccaggttctccgtcttcgccggccagaactccaactcgaactcgaactcgccggaggtgaagcgcgagctgccggagaccgattccaacccgagctccactcacggcggcggaggcggcggctccgtctccgatctcgccatggagaacaagaatccgaagaccgcgaagcggaaggagcgagagaagaaggttaaagcatcatcgaggaagagcaagagcgtcgccgccgccaccgacgagagttccggcgacggcgagaagcttccgtacgttcacgttcgagttcgtcgaggtcaagccactgatagccatagcttagcagaaagggctaggagagagaagataaatgctcggatgaagcttttacaagagctggtcccgggttgcaacaagatatcaggaacggcattggttctagataaaatcatcaaccatgtgcaatctctacagaatgaagtggagatattatcaatgaaactggcagcagttaacccagtaattgatttcaacctcgacagcttactggctaccgaaggagtgactccaatggactgtaacttccctccgacagttgcacctgtcatgtggccagaaatcccacagaacggaaacagacaacaatatcagcaaccgtggcagtttgatgcattccaccaacccctttgggggagggaagaagacaacactaacatgactccagaaaactcactctggagttatgactcatcggcaaattcagtatctctgcattcaaatcagttgaagatggagctc

SEQ ID NO: 326 - protein, 357 aa, Glycine max
  Glyma10g12210.1 (bHLH domain 196-253)
MEQTTLEAIQFNEEIQGLMAAPAPETVNSFKALLELPSTQAVELLHSPERARKPLRHSPKPPTPPPPHPPTSPSFTASASAATANLTFPSNAALIERAARFSVFAGQNSNSNSNSPEVKRELPETDSNPSSTHGGGGGGSVSDLAMENKNPKTAKRKEREKKVKASSRKSKSVAAATDESSGDGEKLPYVHVRVRRGQATDSHSLAERARREKINARMKLLQELVPGCNKISGTALVLDKIINHVQSLQNEVEILSMKLAAVNPVIDFNLDSLLATEGVTPMDCNFPPTVAPVMWPEIPQNGNRQQYQQPWQFDAFHQPLWGREEDNTNMTPENSLWSYDSSANSVSLHSNQLKMEL

SEQ ID NO: 327 - DNA, 1215 bp, Citrus clementina
  clementine0.9_011877m
atggaaccaacggaacacagatccagcgcaattgggccttcgcttgaccaaaatgccctcgactctctccaattcaatgaagaaattcagcatttgatgaccctgccgccagagaacgccaactccttcacagcactcctcgagctgccggccccacaagccgttgaactcctccaccaccaccaccaccgctcacccgaatccaactgctctactgcgaaactagtcaccgcaaaggccgatggacatggacttcaccacccacacgcgacacctcatcatttcaacccaggggcaaacttgacttttccatctgatatctccttgatcgaacgcgccgtgagattctcggtcttcgccggaatcaataacagtgataacaaccacaacgataataataataataatcataaaattagtagtaaaattgataaaaacaataataataataattgctcgccggaaacaactgggtcggtgccgtcgaattcaagcgggaatctcgggaaagtgaagaacgaaccggcagaatcagactccgacaacaacaatccgaattcaccacagccgttggatatcaagaccgagaaccagaatcagaagtcggcgaagagaaaagagcgagagaagaagggcaaagcggcgacaaagaagtctaaaagtggcgctaacgatagcagcgaagatgcggagaaacttccttacgttcacgtccgagctcgtcgtggtcaagctacagatagccacagcttggccgagagagcgaggagagagaagattaatgcacgaatgaagctgttacaagagctggtcccgggctgcaataagatttctgggacagcattagttttagatgagatcatcaaccatgtgcagtcgttacagcgtcaagtggagttcttgtcaatgagacttgcagcagtcaatccaaggattgatttcaatctggacagcttatttgttgcagagagtggatcgttaatcgacagtagcttccctggcatggttatgcctgtaatgtggcctgaactccaagcccatggaaaccgacaacagtatcaacagcaatggcatcattttgatgggcatcaccagcctcttttgggaggagcagaagaaagccataactttgttactcccgagaactcacttttgagttatgattcttcagcaaattcagcaactctgcacacaaatcaattgaagatggagcta

SEQ ID NO: 328 - protein, 405 aa, Citrus clementina
  clementine0.9_011877m (bHLH domain 242-299)
MEPTEHRSSAIGPSLDQNALDSLQFNEEIQHLMTLPPENANSFTALLELPAPQAVELLHHHHHRSPESNCSTAKLVTAKADGHGLHHPHATPHHFNPGANLTFPSDISLIERAVRFSVFAGINNSDNNHNDNNNNNHKISSKIDKNNNNNNCSPETTGSVPSNSSGNLGKVKNEPAESDSDNNNPNSPQPLDIKTENQNQKSAKRKEREKKGKAATKKSKSGANDSSEDAEKLPYVHVRARRGQATDSHSLAERARREKINARMKLLQELVPGCNKISGTALVLDEIINHVQSLQRQVEFLSMRLAAVNPRIDFNLDSLFVAESGSLIDSSFPGMVMPVMWPELQAHGNRQQYQQQWHHFDGHHQPLLGGAEESHNFVTPENSLLSYDSSANSATLHTNQLKMEL

SEQ ID NO: 329 - DNA, 984 bp, Citrus clementina
  clementine0.9_015567m
atggaaccaacggaacacagatccagcgcaattgggccttcgcttgaccaaaatgccctcgactctctccaattcaatgaagaaattcagcatttgatgaccctgccgccagagaacgccaactccttcacagcactcctcgagctgccggccccacaagccgttgaactcctccaccaccaccaccaccgctcacccgaatccaactgctctactgcgaaactagtcaccgcaaaggccgatggacatggacttcaccacccacacgcgacacctcatcatttcaacccaggggcaaacttgacttttccatctgatatctccttgatcgaacgcgccgtgagattctcggtcttcgccggaatcaataacagtgataacaaccacaacgataataataataataatcataaaattagtagtaaaattgataaaaacaataataataataattgctcgccggaaacaactgggtcggtgccgtcgaattcaagcgggaatctcgggaaagtgaagaacgaaccggcagaatcagactccgacaacaacaatccgaattcaccacagccgttggatatcaagaccgagaaccagaatcagaagtcggcgaagagaaaagagcgagagaagaagggcaaagcggcgacaaagaagtctaaaagtggcgctaacgatagcagcgaagatgcggagaaacttccttacgttcacgtccgagctcgtcgtggtcaagctacagatagccacagcttggccgagagagcgaggagagagaagattaatgcacgaatgaagctgttacaagagctggtcccgggctgcaataagatttctgggacagcattagttttagatgagatcatcaaccatgtgcagtcgttacagcgtcaagtggagttcttgtcaatgagacttgcagcagtcaatccaaggattgatttcaatctggacagcttatttgttgcagaggaagtcagaaatctt

SEQ ID NO: 330 - protein, 328 aa, Citrus clementina
  clementine0.9_015567m (bHLH domain 242-299)
MEPTEHRSSAIGPSLDQNALDSLQFNEEIQHLMTLPPENANSFTALLELPAPQAVELLHHHHHRSPESNCSTAKLVTAKADGHGLHHPHATPHHFNPGANLTFPSDISLIERAVRFSVFAGINNSDNNHNDNNNNNHKISSKIDKNNNNNNCSPETTGSVPSNSSGNLGKVKNEPAESDSDNNNPNSPQPLDIKTENQNQKSAKRKEREKKGKAATKKSKSGANDSSEDAEKLPYVHVRARRGQATDSHSLAERARREKINARMKLLQELVPGCNKISGTALVLDEIINHVQSLQRQVEFLSMRLAAVNPRIDFNLDSLFVAEEVRNL

SEQ ID NO: 331 - DNA, 1062 bp, Populus trichocarpa
  POPTR_0006s05600.1
atggatcttacgaccgcatccggagctagatccggacccgagcttgacgaaaccggactggattccttccaactcggtgaagatatccgtcacttaatcactgcgccatcagaaaacgcgagttctttcattgctttactagaattaccagctaaccaagccgtggagttgcttcattcggactcgggtcaaaaacagtacccgaacttgacttttccctcaaacacttccgccatattctccgtttttaatggcggtagtaattcaacggattccagccccgttccgtcaaactcgagctcgaaggatctcgagaaagcatcagccgttaagtgtgagccattagagacggggtcttaccttgattcatctcatccgttggtctctgatccaaccgtggataattcggcgccaaatgcaaggccgtcctcgaagagaaaggaacgagagaagaaggttaaagcagcatcaaagaagagcaaaactgagagttctcaacaagaagaagacatgctgccttacgttcatgttcgagctcggcggggacaagcaacagatagccatagcttagcagaaagagcgaggagagagaagattaatcaaagaatgaagttattacaagaactggtcccaggctgcaataagatttctggtacagcattggttttagatgaaattatcaaccatgtgcagtccctgcaatgtcaagtggagttcttatcaatgagacttgcagcagttaacccaagaattgatttcaatctcgacagcatgttggctgcagaaagtggatctctaattgacagtaacttccccggcatggtaatgcctctgatgtggccagaagccgaagtcaatggaaacagacaccagttccaacagcactggcagtttgatgcgcttcaccagccaatttggggaagagaagaagacagccataacttcattactcccgagaactcacttttaagttacgactcttcagcaaattcaggaaaaaaacaaaagaatgaaagaaaccaacgtccctcattatctcatgacgtctgcctatcttatgaa

SEQ ID NO: 332 - protein, 354 aa, Populus trichocarpa
  POPTR_0006s05600.1 (bHLH domain 181-238)
MDLTTASGARSGPELDETGLDSFQLGEDIRHLITAPSENASSFIALLELPANQAVELLHSDSGQKQYPNLTFPSNTSAIFSVFNGGSNSTDSSPVPSNSSSKDLEKASAVKCEPLETGSYLDSSHPLVSDPTVDNSAPNARPSSKRKEREKKVKAASKKSKTESSQQEEDMLPYVHVRARRGQATDSHSLAERARREKINQRMKLLQELVPGCNKISGTALVLDEIINHVQSLQCQVEFLSMRLAAVNPRIDFNLDSMLAAESGSLIDSNFPGMVMPLMWPEAEVNGNRHQFQQHWQFDALHQPIWGREEDSHNFITPENSLLSYDSSANSGKKQKNERNQRPSLSHDVCLSYE

SEQ ID NO: 333 - DNA, 1092 bp, Vitis vinifera
  GSVIVT01033350001
atggagcgaattgcaggaaccggaggtagatccgggagtaccggaggcgagaaggaggaaatcggagctgagtcgttcctatttggcgaggaaattcaaagactgatgactggtccgccggagaatggaagctccttcacggcactcctcggacttccggcgaatcaagccatggagctcttgcactcgcaggaatctgacacagctcccgccgaactctccggcgaggcgtggagagataaccatatgaatcctcacaaactctactactgttccccgacatttccggcgaacaccactctcatcgaccgcgccgcgaggttctccgtcttcgccgccggcgaaaactcgccggaaactagctcagtcccgtcgaattcctcgcacaaagttaagaatgaacccactgatacagactcgaaccctaattcattaccgccgttgatctccaatccaacggttgagaacaagaatcagcgatcaacgaagcgaaaggagcgagagaagaaggccaaagggtcgacgaaaaagtgcaaaaacgcatcgaatgagacctccgaagaggccgagaagcttccgtacgttcacgttcgagctcgtcgcggccaagccactgatagccatagcttagcagaaagggctaggagagagaagattaacgcccggatgaagcttcttcaagagctggtccctggttgtaataagatttcaggtacagctttagtgctggatgaaattatcagccacgtacaatccctacaacgccaagtagagttcttatctatgagacttgcggcagtaaacccgagaattgatttcaaccttgacagtttattggctccagaaagtggatctctggtcgacagtaacttccctagcatggtcatgccactgatgtggccagatgtccaagccaatgaaaacagacaaccttatcaacagctatggaatgatgacacacttcaccagccagtttggggaagggaagaggacgacccccataatttcattgctccagagcactcgcttttgagttatgactcctcggcaaattcagggtctctgcagtcaaaccagctgaaaatggagctg

SEQ ID NO: 334 - protein, 364 aa, Vitis vinifera
  GSVIVT01033350001 (bHLH domain 201-258)
MERIAGTGGRSGSTGGEKEEIGAESFLFGEEIQRLMTGPPENGSSFTALLGLPANQAMELLHSQESDTAPAELSGEAWRDNHMNPHKLYYCSPTFPANTTLIDRAARFSVFAAGENSPETSSVPSNSSHKVKNEPTDTDSNPNSLPPLISNPTVENKNQRSTKRKEREKKAKGSTKKCKNASNETSEEAEKLPYVHVRARRGQATDSHSLAERARREKINARMKLLQELVPGCNKISGTALVLDEIISHVQSLQRQVEFLSMRLAAVNPRIDFNLDSLLAPESGSLVDSNFPSMVMPLMWPDVQANENRQPYQQLWNDDTLHQPVWGREEDDPHNFIAPEHSLLSYDSSANSGSLQSNQLKMEL

SEQ ID NO: 335 - DNA, 1083 bp, Solanum lycopersicum
  Solyc10g079070.1.1
atggataatctgatagagtgtattgaagcaggagaagctagatccgagaattgcggagctagaatgggagaaattaaagatgggtttcatcaatttggtgaggaaattttgtctgttacgtcggaaggtggaagttctttcactgctttacttgggcttccgccgaatcaagcggtggagcttttggttcagtcaccggaaactgacaaaatagcatcagataagcttgctatcagtgaacctcactatcgttatcctcctcctcctccgatttttccttcagatatcgctttgatcgatagagcttctaagttctccgtcttcgccgccgccggtaactccccggagtccaattcaaccctttcgaattccgggtcgaaatcactgttcgtcaagcaagaacccctagattccgaatgtaaccacaactcatctccggcgacttccaatccactagtccatcagaaatcaacaaagagaaaggaacgcgagaaaaaggtaaaagaaacttctaaaaaggggaaaaaatcagctaacgatacctcagaagacggcggcgagaagctaccatatgttcacgtccgagcgcgtcgaggccaagccactgatagccatagtttagcagaaagagcaaggagagagaagattaatgctaggatgaagctactacaagaactggtcccaggatgtaacaagatttcaggtactgcaatggtgttggatgagatcatcaaccatgtacagtccctacagcgccaagtggagttcttatcaatgagacttgctgcggttaacccgagagttgatttcaacctcgaaagtctttttgcagcagaacggagtggttcccatgtggagagtaacttacaagacatggttgtgccgcctatctgggctgagggacaaagcagcggaaacagaaaccaatatcaacatctatggcttattgaagggttccatcagcctgcctggggaaggttagaagacaattctagctttgttacaccagagaactcgctgttgacatatgattcctcagcaaattcagcatctttacatccaaatcagctgaaaatggagcta

SEQ ID NO: 336 - protein, 361 aa, Solanum lycopersicum
  Solyc10g079070.1.1 (bHLH domain 198-255)
MDNLIECIEAGEARSENCGARMGEIKDGFHQFGEEILSVTSEGGSSFTALLGLPPNQAVELLVQSPETDKIASDKLAISEPHYRYPPPPPIFPSDIALIDRASKFSVFAAAGNSPESNSTLSNSGSKSLFVKQEPLDSECNHNSSPATSNPLVHQKSTKRKEREKKVKETSKKGKKSANDTSEDGGEKLPYVHVRARRGQATDSHSLAERARREKINARMKLLQELVPGCNKISGTAMVLDEIINHVQSLQRQVEFLSMRLAAVNPRVDFNLESLFAAERSGSHVESNLQDMVVPPIWAEGQSSGNRNQYQHLWLIEGFHQPAWGRLEDNSSFVTPENSLLTYDSSANSASLHPNQLKMEL

SEQ ID NO: 337 - DNA, 669 bp, Brachypodium distachyon
  Bradi3g17790.1
atggatcaacactcacagacaaaggtagaggatgtagtgatggtatctggagctccatcagcaggcactgcctttcctgcaggctccaatggtggtccagtcgtttatgcggccgccccactacagcagcaacttccactccaacagaagcaggaggttcagcaacagcttcagaccttctgggccgaccgaaagactgagatcgagcagataaccgactgcaagacccacagcctacccctcgcgaggatcaagaagataatgaaggctgatgaggacgtccagatgatcgctggtgaggcgccagcggtcttcgcgaaggcctgcgagatgttcattctggagctgacgctgaggtcgtggctccaaaccagagagaacaataggaatacactgcagaaaaatgatatcgccactgtggtctccaggaatgacgactttgatttcctggtggacgtcatgcaggagaatggcgcggtgttgccacctgtgaccttgcagaccatggtcccaggaatgggcattccctttggaatgtatggaaaccagctgccaactgctttcgcttggccgcagccggagcagcagcccccttacaatggtgagcagcagcaggaggaggaggaggaggaggaggaggagccgccttacaacggtggacaagacgta

SEQ ID NO: 338 - protein, 223 aa, Brachypodium distachyon
  Bradi3g17790.1 (NF-Y_histone-like domain 77-141)
MDQHSQTKVEDVVMVSGAPSAGTAFPAGSNGGPVVYAAAPLQQQLPLQQKQEVQQQLQTFWADRKTEIEQITDCKTHSLPLARIKKIMKADEDVQMIAGEAPAVFAKACEMFILELTLRSWLQTRENNRNTLQKNDIATVVSRNDDFDFLVDVMQENGAVLPPVTLQTMVPGMGIPFGMYGNQLPTAFAWPQPEQQPPYNGEQQQEEEEEEEEEPPYNGGQDV

SEQ ID NO: 339 - DNA, 1167 bp, Brachypodium distachyon
  Bradi3g17800.1
atgaatcaacactcgcagccaaggacagaggcggatgccacaaacgacacacctgtagcatatgtggcagggacagtatatggagttgcgccagtaggagtcatctttcctgcaggtaccgtctttcatgtaggaccccgtggtggtccaatctatgcggccaccccagtgaaacaggaggaccagcaccagcagcagcttcaggccttctggaccgaccggctggatgagatcgagcacatgagcgactttaagatccacagccttccccttgcgaggatcaagaagatcatgaaggctagcggggagaatgtccacatgatcgcgggggaggcgcctggggtcctacctaaggcgtgtgagatcttcatccaggagctgacgctgagatcatggctccaaaccagagaaaaaaataggaggacgctgttaagacataagtgcatgtatcttttggccatggatcaacactcgcagccaaggacagaggcggatgccacaaacgacacatctgtagcatatttggcagggacggaatctggacctgcgccagcaggcgtcgtctttcccgcaggtaccgtctttcatgtaggaccctatggtggtccagtctatgcagccctcccaatgcagcaggaggaccagcaccagcaacagcttcaggccttctggagcgaccggctggatgagatcgagcacatgagcgacttcaagacccacagccttccccttgcgaggatcaagaagatcatgaaggctagcggggagaatgtccagatgatcgcgggggaggcgcatgggctcctagctaaggcgtgtgagatcttcatccaggagctgacgctgagatcgtggctccaaaccagagaaaataataggaggacgctgcagaagaatgacatcgccgctgcggtctccaggaacgaggcctttgatttccttgtggacatcatgcaggacaatggtgcggggttgccgactgggaccatgcagaccatggtcccaggaatgggcacctttgaaatgtactgtggaaaccagcaaccagttcctttcgcgtggccgcagccgcagcagcagcagtcgcctcacaacggtgagcagcagcatcagccgccttacaatggtgagcagcaacagccgccttccagtggtggacaagatgaa

SEQ ID NO: 340 - protein, 389 aa, Brachypodium distachyon
  Bradi3g17800.1 (NF-Y_histone-like domain 240-305)
MNQHSQPRTEADATNDTPVAYVAGTVYGVAPVGVIFPAGTVFHVGPRGGPIYAATPVKQEDQHQQQLQAFWTDRLDEIEHMSDFKIHSLPLARIKKIMKASGENVHMIAGEAPGVLPKACEIFIQELTLRSWLQTREKNRRTLLRHKCMYLLAMDQHSQPRTEADATNDTSVAYLAGTESGPAPAGVVFPAGTVFHVGPYGGPVYAALPMQQEDQHQQQLQAFWSDRLDEIEHMSDFKTHSLPLARIKKIMKASGENVQMIAGEAHGLLAKACEIFIQELTLRSWLQTRENNRRTLQKNDIAAAVSRNEAFDFLVDIMQDNGAGLPTGTMQTMVPGMGTFEMYCGNQQPVPFAWPQPQQQQSPHNGEQQHQPPYNGEQQQPPSSGGQDE

SEQ ID NO: 341 - DNA, 1023 bp, Brachypodium distachyon
  Bradi3g17820.1
atgagcgactttaagatccacagccttccccttgagaggatcaagaagatcatgaaggctagcggggagaatgtccaggtgatcgcgggggaggcgcctggggtcctaactaaggcgtgtgagatcttcatccaagagctgacgctgagatcgtggctccaaaccagagaaaaaaataggaggacgctgcaaaagaatgacatcgccgctgcggtctccaggaacgaggcctttgatttccttgtggacatcatgcaggacaatggcgtggggttgccgactgggaccatgcagaccatgatcccgggaatgggcaccttcggaatgtactatgaaaacctaaccagcaaccagttcctttcgcgtggccgcagccggagcagcagcagtcgcctcacaacgttaccatcatggaatcacaataggaggacgctgcagaagaatgacatcgcggctacggtctcgaggaatgatacttttgatttcctgatggacatcatgcaggagaatgagaacaagccggttcatactgaagaagtgcaccttggccatggatcaacactcacggccacaaacaacaccttggccatggatcaacccatacaggctctcgggcgtgtacacctcgacgctctgggccgcgccggtgacggggttgacgaggacgaggacaacgcggttgctcctcgcggacgaccggccgccgtcagccgcatcgtgggggcgcaggcgaagaagacgcagccgttgggcaaggcgccggatagcttcatgtgcggccgcgcgggcgctggatgtgcggaggcggcggcggagctcgatctgtggcggcggcttcgccatccttcttcatcgggcgagcagagggatgcgagcggcggagggcggcgcgaggaaagtggtattgggttgtcaccagcgaccatgcagactattgtcccggccggggatagacattccctttcacttggccgcagccggagcagcagcagcagccaccttagaatggtggacaagagaaat

SEQ ID NO: 342 - protein, 341 aa, Brachypodium distachyon
  Bradi3g17820.1 (NF-Y_histone-like domain 7-72)
MSDFKIHSLPLERIKKIMKASGENVQVIAGEAPGVLTKACEIFIQELTLRSWLQTREKNRRTLQKNDIAAAVSRNEAFDFLVDIMQDNGVGLPTGTMQTMIPGMGTFGMYYENLTSNQFLSRGRSRSSSSRLTTLPSWNHNRRTLQKNDIAATVSRNDTFDFLMDIMQENENKPVHTEEVHLGHGSTLTATNNTLAMDQPIQALGRVHLDALGRAGDGVDEDEDNAVAPRGRPAAVSRIVGAQAKKTQPLGKAPDSFMCGRAGAGCAEAAAELDLWRRLRHPSSSGEQRDASGGGRREESGIGLSPATMQTIVPAGDRHSLSLGRSRSSSSSHLRMVDKRN

SEQ ID NO: 343 - DNA, 726 bp, Brachypodium distachyon
  Bradi3g17810.1
atggatggacactcgcagccatgggcagaggcggatgccacaaacgtcaacagtacacctgtagcatatgtggcacctgggacggtatctggagctgcgccagcaggcgcggccgcctttccggcaggtacagtctttgctgcaggctccagtggcggtccagtcgtctatgcggcaaccccgctgcagcaggtgcgtcatcccctccagcaggaggaccagcaccagcaaaagctgcaagacttctggaccgaaacgctggctgagatagagcacatgagcgagatcaagcctcacagccttcccctcgcgaggataaagaagatcatgaaggctagcggggaggacattcggatgatcgccagcgaggcgcctgggctcttggctaaggcctctgagatcttcatccaggagctgacgctgaggtcatggctcgaaaccagagataacaataggaggacgctgcaaaagaacgacatcggcgctgcggtctccagaaatgagacctttgatttcctggtggatgtcatgcaggacaatggcgtggggtttccgtctgcgaccgtacagaccgcggtcctgggaatgagcacctttggaatgtactatggaaaccagcagcagccagttcctttcgcgtggctgcagccggagcatcagccgccaccttacaatggtgagcagcagcagcagccgccgccgccttccagtgatggacaagatgaa

SEQ ID NO: 344 - protein, 242 aa, Brachypodium distachyon
  Bradi3g17810.1 (NF-Y_histone-like domain 99-164)
MDGHSQPWAEADATNVNSTPVAYVAPGTVSGAAPAGAAAFPAGTVFAAGSSGGPVVYAATPLQQVRHPLQQEDQHQQKLQDFWTETLAEIEHMSEIKPHSLPLARIKKIMKASGEDIRMIASEAPGLLAKASEIFIQELTLRSWLETRDNNRRTLQKNDIGAAVSRNETFDFLVDVMQDNGVGFPSATVQTAVLGMSTFGMYYGNQQQPVPFAWLQPEHQPPPYNGEQQQQPPPPSSDGQDE

SEQ ID NO: 345 - DNA, 1590 bp, Oryza sativa
  LOC_Os08g10560.1
atgttatcctctatgttcctcttcctcctccctctctcccttctctctttctctctcttgggcaatctgtgggcaggggcggcgacgtcggcgggcgagggctggagcagcgtcgggctgcggctcatgctactaggaggtgctactccatttttctacattaacatcgagacggtgatcatcaccaacatgaactactacccggaggggtccaacccggtgtacttcgccgtgctcgtcaagtacgaggacctcgacggcgacgtcgtgcaggtcgacctcatggagtccaagtcggcgtacggcggcgccatcggagtgtggacaccgatgagggagtcatggggctccgcatcggcagtgacatcggcaagaccctttgtcaccaacaacgtcatcccagccatctggtctcgaatcgcgccatcactgcctccgtcaccccttccgcgccgacctcgttccgcgctcgcccactgccgcgcctctcccgcctcggtctctccctctgcccgcgcctccccgacgccaccctcgccgcgctcaccgccgcaccgtccatctcgcagtcgacatctcctgctctcggggattcctgctgctgcgcttgtcgttgcatgcccgaatctgaatgatctcgacttctccaatgaccactatggctcgacctcaggaatgcggcggcggcggaggtggccaagttgtgtggggttttgggggggttttggcgatggagatggtgatcgttattccatcaccttctctgcatatattgtagtgttaagaactcaagaggcatatgtgcagatcctacagcagttgcataggagtacatctttagaaatggacccacattcacacaagaaggcacatgaaggtctgattggtgacaaccctgacgcgtatgccgtgacgacataccaacctgtgctgatggtagaaccatcagccgctgctgccttccctccagctccccaggttgctccagcctatccagtgaacccaatgcagcttccagagcatcagcagcacgcaatccagcaagttcagcagctccagcagcagcagaaggagcagctccaggcgttctgggccgaccagatggccgaggttgaacagatgactgagttcaagctccccaacctcccgcttgcaaggatcaagaagatcatgaaggccgatgaggacgtcaagatgatcgcgggcgaggcaccggcgctcttcgccaaggcctgcgagatgttcatcctggacatgacgctgcggtcctggcagcacaccgaggagggcaggaggaggacgctgcagaggagcgacgtcgaggcggtgatcaagaagaccgacatcttcgatttcttggtggatatcatcactgatgataagatgaaggatgatggcatgggctctcaggctgcatccatggtttcgccatatacctcaggaggaatgggattttcctttgatctgtacccgaaccagcatcacctcgcatatatgtggcctccacaagagcagcaggagcagtggcctccacaggagcagcaggagcagaagcagaagcaggattctgatggtggtggacaagatgaa

SEQ ID NO: 346 - protein, 530 aa, Oryza sativa
  LOC_Os08g10560.1 (NF-Y_histone-like domain 380-444)
MLSSMFLFLLPLSLLSFSLLGNLWAGAATSAGEGWSSVGLRLMLLGGATPFFYINIETVIITNMNYYPEGSNPVYFAVLVKYEDLDGDVVQVDLMESKSAYGGAIGVWTPMRESWGSASAVTSARPFVTNNVIPAIWSRIAPSLPPSPLPRRPRSALAHCRASPASVSPSARASPTPPSPRSPPHRPSRSRHLLLSGIPAAALVVACPNLNDLDFSNDHYGSTSGMRRRRRWPSCVGFWGGFGDGDGDRYSITFSAYIVVLRTQEAYVQILQQLHRSTSLEMDPHSHKKAHEGLIGDNPDAYAVTTYQPVLMVEPSAAAAFPPAPQVAPAYPVNPMQLPEHQQHAIQQVQQLQQQQKEQLQAFWADQMAEVEQMTEFKLPNLPLARIKKIMKADEDVKMIAGEAPALFAKACEMFILDMTLRSWQHTEEGRRRTLQRSDVEAVIKKTDIFDFLVDIITDDKMKDDGMGSQAASMVSPYTSGGMGFSFDLYPNQHHLAYMWPPQEQQEQWPPQEQQEQKQKQDSDGGGQDE

SEQ ID NO: 347 - DNA, 579 bp, Setaria italica
  Si015775m
ccagcctcccagggtgcccctactgcctaccaaactgccatcccgccgccgctctccaaccagcaccaggccgcgttactccagaagttacagcagcaacagctccaggctttctgggccggccagctggctgaggccgagcaggcaacggacctcaaggtccacagcctgcccctggcgcgcatcaagaagatcatgaaggccgacgaggacgtcaagatgatcgcggccgaggcgcccgtggtgttcgccaaggcctgcgagatgttcatcctcgagctcacgctgcggtcgtggctccacaccgaggggaccaagcgccggacgatgcagcggagcgacgtctctgcggcgatcatggccaacgagatgtttgatttcctgatggatgtcactccgacggagcagcagacaaacggggatggagttctgccgccaccgccaccgctgcagacgacagccggccaggtcccctttccaatgcacgtcccctttccaatgtatgcgaaccaccagcctccattcatgtggccgacgccggagtatcagcagcagcagaatcctggtggtgggaatgag

SEQ ID NO: 348 - protein, 193 aa, Setaria italica
  Si015775m (NF-Y_histone-like domain 55-119)
PASQGAPTAYQTAIPPPLSNQHQAALLQKLQQQQLQAFWAGQLAEAEQATDLKVHSLPLARIKKIMKADEDVKMIAAEAPVVFAKACEMFILELTLRSWLHTEGTKRRTMQRSDVSAAIMANEMFDFLMDVTPTEQQTNGDGVLPPPPPLQTTAGQVPFPMHVPFPMYANHQPPFMWPTPEYQQQQNPGGGNE

SEQ ID NO: 349 - DNA, 561 bp, Arabidopsis thaliana
  AT5G27910.1
atggagaacaacaacggcaacaaccagctgccaccgaaaggtaacgagcaactgaagagtttctggtcaaaagagatggaaggtaacttagatttcaaaaatcacgaccttcctataactcgtatcaagaagattatgaagtatgatccggatgtgactatgatagctagtgaggctccaatcctcctctcgaaagcatgtgagatgtttatcatggatctcacgatgcgttcgtggctccatgctcaggaaagcaaacgagtcacgctacagaaatctaatgtcgatgccgcagtggctcaaactgttatctttgatttcttgcttgatgatgacattgaggtaaagagagagtctgttgccgccgctgctgatcctgtggccatgccacctattgacgatggagagctgcctccaggaatggtaattggaactcctgtttgttgtagtcttggaatccaccaaccacaaccacaaatgcaggcatggcctggagcttggacctcggtgtctggtgaggaggaagaagcgcgtgggaaaaaaggaggtgacgacggaaac

SEQ ID NO: 350 - protein, 187 aa, Arabidopsis thaliana
  AT5G27910.1 (NF-Y_histone-like domain 35-99)
MENNNGNNQLPPKGNEQLKSFWSKEMEGNLDFKNHDLPITRIKKIMKYDPDVTMIASEAPILLSKACEMFIMDLTMRSWLHAQESKRVTLQKSNVDAAVAQTVIFDFLLDDDIEVKRESVAAAADPVAMPPIDDGELPPGMVIGTPVCCSLGIHQPQPQMQAWPGAWTSVSGEEEEARGKKGGDDGN

SEQ ID NO: 351 - DNA, 558 bp, Arabidopsis thaliana
  AT5G50490.1
atggagaacaacaacaacaaccaccaacagccaccgaaagataacgagcaactaaagagtttctggtcaaaggggatggaaggtgacttgaatgtcaagaatcacgagttccccatctctcgtatcaagaggataatgaagtttgatccggatgtgagtatgatcgctgctgaggctccaaatctcttatctaaggcttgtgaaatgtttgtcatggacctcacgatgcgttcatggctccatgctcaagagagcaaccgactcacgatacggaaatctgatgttgatgccgtagtgtctcaaaccgtcatctttgatttcttgcgtgatgatgtccctaaggacgagggagagcccgttgtcgccgctgctgatcctgtggacgatgttgctgatcatgtggctgtgccagatcttaacaatgaagaactgccgccgggaacggtgataggaactccggtttgttacggtttaggaatacacgcgccacacccgcagatgcctggagcttggaccgaggaggatgcgactggggcaaatggaggaaacggtgggaat

SEQ ID NO: 352 - protein, 186 aa, Arabidopsis thaliana
  AT5G50490.1 (NF-Y_histone-like domain 35-99)
MENNNNNHQQPPKDNEQLKSFWSKGMEGDLNVKNHEFPISRIKRIMKFDPDVSMIAAEAPNLLSKACEMFVMDLTMRSWLHAQESNRLTIRKSDVDAVVSQTVIFDFLRDDVPKDEGEPVVAAADPVDDVADHVAVPDLNNEELPPGTVIGTPVCYGLGIHAPHPQMPGAWTEEDATGANGGNGGN

SEQ ID NO: 353 - DNA, 636 bp, Arabidopsis thaliana
  AT5G50470.1
atggaagagaacaacggcaacaacaaccactacctgccgcaaccatcgtcttcccaactgccgccgccaccattgtattatcaatcaatgccgttgccgtcatattcactgccgctgccgtactcaccgcagatgcggaattattggattgcgcagatgggaaacgcaactgatgttaagcatcatgcgtttccactaaccaggataaagaaaatcatgaagtccaacccggaagtgaacatggtcactgcagaggctccggtccttatatcgaaggcctgtgagatgctcattcttgatctcacaatgcgatcgtggcttcataccgtggagggcggtcgccaaactctcaagagatccgatacgctcacgagatccgatatctccgccgcaacgactcgtagtttcaaatttaccttccttggcgacgttgtcccaagagacccttccgtcgttaccgatgatcccgtgctacatccggacggtgaagtacttcctccgggaacggtgataggatatccggtgtttgattgtaatggtgtgtacgcgtcaccgccacagatgcaggagtggccggcggtgcctggtgacggagaggaggcagctggggaaattggaggaagcagcggcggtaat

SEQ ID NO: 354 - protein, 212 aa, Arabidopsis thaliana
  AT5G50470.1 NF-Y_histone-like domain 62-132)
MEENNGNNNHYLPQPSSSQLPPPPLYYQSMPLPSYSLPLPYSPQMRNYWIAQMGNATDVKHHAFPLTRIKKIMKSNPEVNMVTAEAPVLISKACEMLILDLTMRSWLHTVEGGRQTLKRSDTLTRSDISAATTRSFKFTFLGDVVPRDPSVVTDDPVLHPDGEVLPPGTVIGYPVFDCNGVYASPPQMQEWPAVPGDGEEAAGEIGGSSGGN

SEQ ID NO: 355 - DNA, 606 bp, Arabidopsis thaliana
  AT5G50480.1
atggctgagaacaacaacaacaacggcgacaacatgaacaacgacaaccaccagcaaccaccgtcgtactcgcagctgccgccgatggcatcatccaaccctcagttacgtaattactggattgagcagatggaaaccgtctcggatttcaaaaaccgtcagcttccattggctcgaattaagaagatcatgaaggctgatccagatgtgcacatggtctccgcagaggctccgatcatcttcgcaaaggcttgcgaaatgttcatcgttgatctcacgatgcggtcgtggctcaaagccgaggagaacaaacgccacacgcttcagaaatcggatatctccaacgcagtggctagctctttcacctacgatttccttcttgatgttgtccctaaggacgagtctatcgccaccgctgatcctggctttgtggctatgccacatcctgacggtggaggagtaccgcaatattattatccaccgggagtggtgatgggaactcctatggttggtagtggaatgtacgcgccatcgcaggcgtggccagcagcggctggtgacggggaggatgatgctgaggataatggaggaaacggcggcggaaat

SEQ ID NO: 356 - protein, 202 aa, Arabidopsis thaliana
  AT5G50480.1 (NF-YC6, G1820, NF-Y_histone-like domain 53-117)
MAENNNNNGDNMNNDNHQQPPSYSQLPPMASSNPQLRNYWIEQMETVSDFKNRQLPLARIKKIMKADPDVHMVSAEAPIIFAKACEMFIVDLTMRSWLKAEENKRHTLQKSDISNAVASSFTYDFLLDVVPKDESIATADPGFVAMPHPDGGGVPQYYYPPGVVMGTPMVGSGMYAPSQAWPAAAGDGEDDAEDNGGNGGGN

SEQ ID NO: 357 - DNA, 432 bp, Solanum lycopersicum
  Solyc00g107050.1.1
atggaaaacaactctgagaaatccacagtgaatgcaactcaatccgttgatgcgtactcaacgatgtctcatcttaacattgaaaagattgagcaagaatatatggagatgttttggacagaccaggagagagaaatggagaaaattgacaatttcaagaacaatctgctagtttcacctaaccgtatcaagaacatcatgaagacgaacaaggatgtccgaaggatcacttctgaatcgcctgttttgcttgctaaggcatgtgattttttcattcaagaactcacccttcgttcctggcttaacgctcaagaaaatcatcgacgtattttgaagaagaaagatgtcaccgatgtgattaagcggaatgacaatttgaatttcctttttgatgatgatgttaattctactggaggcaacaatggacataca

SEQ ID NO: 358 - protein, 144 aa, Solanum lycopersicum
  Solyc00g107050.1.1 (NF-Y_histone-like domain 55-120)
MENNSEKSTVNATQSVDAYSTMSHLNIEKIEQEYMEMFWTDQEREMEKIDNFKNNLLVSPNRIKNIMKTNKDVRRITSESPVLLAKACDFFIQELTLRSWLNAQENHRRILKKKDVTDVIKRNDNLNFLFDDDVNSTGGNNGHT

SEQ ID NO: 359 - DNA, 459 bp, Solanum lycopersicum
  Solyc02g021330.1.1
atgaaaaataattttgataaactcgtagtgaatgcaactcaatcctctacgcacccaacgttggcacaacttaatattgtgaagaataaacaagaacaactggagatgttttggacaaatcagcggagagaaatagagaacgataacgagttcaagaacaatcatctactcccgcctaaccttatcaaaaagctcatgaagacggatgaggatgaccagatgattgctgctgaatcacccgttttgctagctaagacatgtgagttgttcattcaagaactcactcttcgttcctggcttaatgctcaggaaaagcatcaacatattctgaagaaggatgacgtcactgatgtgattatacagactgacaatttggattttcttcttgttgttgttgatgatgctatcgatggctccacaccaagtattgtgccattctatattgctggaggcaataat

SEQ ID NO: 360 - protein, 153 aa, Solanum lycopersicum
  Solyc02g021330.1.1 (NF-Y_histone-like domain 54-119)
MKNNFDKLVVNATQSSTHPTLAQLNIVKNKQEQLEMFWTNQRREIENDNEFKNNHLLPPNLIKKLMKTDEDDQMIAAESPVLLAKTCELFIQELTLRSWLNAQEKHQHILKKDDVTDVIIQTDNLDFLLVVVDDAIDGSTPSIVPFYIAGGNN

SEQ ID NO: 361 - DNA, 486 bp, Solanum lycopersicum
  Solyc03g110840.1.1
atgtctgagctttcaaacgtagagaaaaccaccatgaaaaataactctgagaaatcgatagtgaatgcagctcaatccactggataccctacgttggagatgttctggaaatcccaacagagtcaaatggagaacattaaagatttcaaggacaggttgctacttccaccaactcgtatcaagaagatcatgaagaagaacgaggatgtccgaatggtcgcgggtgaatcaccagttttgctggctaaggcatgtgagttgttcattcaagacctcacccttcgttcctcgattcacgctcaggaaaatcatcgacgtattctgaagaaggatgaccttactgatgtgattgtgcagactgactattttgattttcttcttgatgttgttcataggaatggtgcaaccgaccctttcacaccaaattctgttccgttatatgctgctggaggtagcaatgaagaggacggtaataatcttgatcaa

SEQ ID NO: 362 - protein, 162 aa, Solanum lycopersicum
  Solyc03g110840.1.1 (NF-Y_histone-like domain 52-117)
MSELSNVEKTTMKNNSEKSIVNAAQSTGYPTLEMFWKSQQSQMENIKDFKDRLLLPPTRIKKIMKKNEDVRMVAGESPVLLAKACELFIQDLTLRSSIHAQENHRRILKKDDLTDVIVQTDYFDFLLDVVHRNGATDPFTPNSVPLYAAGGSNEEDGNNLDQ

SEQ ID NO: 363 - DNA, 489 bp, Solanum lycopersicum
  Solyc03g110850.1.1
atggaaaacaactatgagaaatcagcagtgaatgcaggtcaatccgctgcgtatccaatgttgtcgccgcctcaccttgagaaaaagcaagaaaagctggagatgttttggacagacaagcggagagaaatggagaatgttattgatttcaagagcaacctgctacctcgaattcaccgcatcaagaagatcatgaagacagacaaggatgtcagaatgattgctactgaatcacctgttttgttggctaaagcatgtgagttgttcattcaagaactcactcttcgttcctggtttaaagctgaggaaaatcatcgtcgtattttgaagaaggatgacgtcactgatgtgattatggagactgacacattggatttccttcttgatgatgatgctaatgttactgacggctccacacaaaatgttgttccgttttatgttgctgaaggcacaatgggcgtacatactgataatcttgatcatcaaatg

SEQ ID NO: 364 - protein, 163 aa, Solanum lycopersicum
  Solyc03g110850.1.1 (NF-Y_histone-like domain 53-118)
MENNYEKSAVNAGQSAAYPMLSPPHLEKKQEKLEMFWTDKRREMENVIDFKSNLLPRIHRIKKIMKTDKDVRMIATESPVLLAKACELFIQELTLRSWFKAEENHRRILKKDDVTDVIMETDTLDFLLDDDANVTDGSTQNVVPFYVAEGTMGVHTDNLDHQM

SEQ ID NO: 365 - DNA, 414 bp, Solanum lycopersicum
  Solyc11g016920.1.1
atggaaaacaactctgagaaatcagcagtgaatgcaggtcaatctgatgtgtattcaatgttggcgctgcctcaccttgagaaaaagcaagaaaagctagagatgttttggatagacaagcagagggaaatggagaatgttattgatttcaagagcaacctgctaccttcaattaaccgcatcaagaagatcatgaagacagacaaggatgtcagaatgattgctactgaatcacctgttttgttggctaaagcatgtgagttgttcattcaagaactaactcttcgttcctggtttaaaactgagaaaaatcatcgtcgtattttgaagaaggatgacgtcactgatgtgattatggagactgacattttggatttccttcttgatgatgatgctgatgtagcttttgatgtt

SEQ ID NO: 366 - protein, 138 aa, Solanum lycopersicum
  Solyc11g016920.1.1 (NF-Y_histone-like domain 53-118)
MENNSEKSAVNAGQSDVYSMLALPHLEKKQEKLEMFWIDKQREMENVIDFKSNLLPSINRIKKIMKTDKDVRMIATESPVLLAKACELFIQELTLRSWFKTEKNHRRILKKDDVTDVIMETDILDFLLDDDADVAFDV

SEQ ID NO: 367 - DNA, 864 bp, Solanum lycopersicum
  Solyc03g111460.1.1
atggcaagtcactctgacccggtggcagccaatgcagaggtggcggcggcggtgaatgcagaggaggaggtggcggaggcgactgctcagccgattgtgaacgcgaacgattatctccttcagcagcagttgcggttgttttgggcagctcagcttcaagagatcatacagataagagatttcaggggccacagtcttcccatttctcgaatcaagaaaatcatgaaatcggacaaggaagtccgtatgatttctgctgaatcgcctattctgcttgctaaggcatgtgagctctttattcaggagctcacccatcgttcctggcttaaggcccaagaatgtcagcgtcagactctaaaaaagattgacttatttacggtgcttaaggagactgaactctttgatttccttgtggatgtcatttctatggatgagccagaggaagaagctcctacttacgtgcctggcatgttgggtaatataccaaatcgtatctcgtactattactcaccaatgggacctcctgctccaccaatggcacctcttgctccatcagtgagacctcctgctccatcaatggggccacctgctccatcaatgcctacttcacccagggggatcatgggaaggcgtgctatgccttgggttgcaccatcaatgcacgtcccgcctccgttgtacccgcggaagttcggttggtatgctgctggcggtaatccatatttaaaggtcatgcctcttttgatccaaatgctcagtggcactggcacaacggaagctcttagtggtatgatggagccaccaaggcttattggttataggatgattagtaagcctagtggggcaatttggcgtagtggtcat

SEQ ID NO: 368 - protein, 288 aa, Solanum lycopersicum
  Solyc03g111460.1.1 (NF-Y_histone-like domain 64-128)
MASHSDPVAANAEVAAAVNAEEEVAEATAQPIVNANDYLLQQQLRLFWAAQLQEIIQIRDFRGHSLPISRIKKIMKSDKEVRMISAESPILLAKACELFIQELTHRSWLKAQECQRQTLKKIDLFTVLKETELFDFLVDVISMDEPEEEAPTYVPGMLGNIPNRISYYYSPMGPPAPPMAPLAPSVRPPAPSMGPPAPSMPTSPRGIMGRRAMPWVAPSMHVPPPLYPRKFGWYAAGGNPYLKVMPLLIQMLSGTGTTEALSGMMEPPRLIGYRMISKPSGAIWRSGH

SEQ ID NO: 369 - DNA, 819 bp, Solanum lycopersicum
  Solyc03g111470.1.1
atggcaagtcactctgacccgatggcagcgaatgtagaggtggcaacgtcggtgaatgcagaggctgctgctgcggcggtgaatgtaaaggcggtggcggtggcggaggcaactgctcagccggttgtaaacgcaaacaattatctcctccagcagcagttgcagttgttttgggcagctcaacttcaagagatcatgcagataggagatttcgagggtcacagtcttcccattttccgaatcaagaagatcatgaaatcggacaaggaagtccgtatgatttctgctgaatcacctattctacttgataaggcatgtgagctttttattcaggagctcacccatcgttcctggcttaaggcccaggaatgccagcgccggactctgaaaaagatcgacttctttacgacagaggaagaagctcctacttacgtgcctggcatgctgggtaacataccaaatcatatcccgtactgttactcaccaatgggacctcctgctccaccaatggcacctcttgctccatcaatgggacctcctgctccatcaatggagccacctgctccatcaatgcctgctccacccagggggatcatgggaaggcgtgctatgccttgggttactacctcaatgcacgtcccgcctccgttgtacccgcggcagttcggttggtatgctgctggcgataatccatatgctactagagggagcagtgggcagggtagcggtgatcctcaaagtggtatgatggagccaccaaggcttattggttacaggatgattagtaagcctagtggggcaatttggcgtagtggtcat

SEQ ID NO: 370 - protein, 273 aa, Solanum lycopersicum
  Solyc03g111470.1.1 (NF-Y_histone-like domain 74-138)
MASHSDPMAANVEVATSVNAEAAAAAVNVKAVAVAEATAQPVVNANNYLLQQQLQLFWAAQLQEIMQIGDFEGHSLPIFRIKKIMKSDKEVRMISAESPILLDKACELFIQELTHRSWLKAQECQRRTLKKIDFFTTEEEAPTYVPGMLGNIPNHIPYCYSPMGPPAPPMAPLAPSMGPPAPSMEPPAPSMPAPPRGIMGRRAMPWVTTSMHVPPPLYPRQFGWYAAGDNPYATRGSSGQGSGDPQSGMMEPPRLIGYRMISKPSGAIWRSGH

SEQ ID NO: 371 - DNA, 954 bp, Solanum lycopersicum
  Solyc03g111450.1.1
atggagaacaatgatcaacaacccatggagatcaatcaacaacaaccgatggagaacaatgatcaacaagccatggagatcaatcaacaacaaccaatggagaacaatgatcaacaacccatggagatcaatcaacaacaaccggtggagcctctgtaccctggttaccccttctaccaaatgctgcttcatcagcagcatcaacagctgcagctgcagctacagcagcaggtggaagagcaaatgaggattttctggaactgtcagcgtgaggaaattgaggagatggatgattttaagcatcatcactttcctatttccaggatcaagaggattataaaatctgaaaacaatgccattaagctatctgctgaaacaccgattttgttttcaaaggcatgtgagctctttgttctggagctcactcttcgttcctggtttcacgcccagcaaaacaaccgtgggtctcttaagaaaactgacttcgctgccgctattaggcggactgaggtttttgatttccttgctgacgtcgtccctgaggatgagatcaatgaagtggctactggttttgggcctggcatggtgggacccacagtaggtggtggttttccctatttttatccacctatgggactgcttgctatgcctggggtgatgccaggaggtcctgctatgcttggggtgatgccaggagggcctgctatgcttgggccgatgccaggagggcctgctatgcctgggccgatgataggagggccttctatgcctgggccgatgataggagggcctgctgtggctgtggttgctccttcagtatacgttcagcctccattgcaggcgtggcagcctgctggtgataatcccaatgctggtggagagagcgatggacagggtggtatctttcttctttttctgagaagtgacgaaggaaacgttttccgccggagggtt

SEQ ID NO: 372 - protein, 318 aa, Solanum lycopersicum
  Solyc03g111450.1.1 (NF-Y_histone-like domain 102-166)
MENNDQQPMEINQQQPMENNDQQAMEINQQQPMENNDQQPMEINQQQPVEPLYPGYPFYQMLLHQQHQQLQLQLQQQVEEQMRIFWNCQREEIEEMDDFKHHHFPISRIKRIIKSENNAIKLSAETPILFSKACELFVLELTLRSWFHAQQNNRGSLKKTDFAAAIRRTEVFDFLADVVPEDEINEVATGFGPGMVGPTVGGGFPYFYPPMGLLAMPGVMPGGPAMLGVMPGGPAMLGPMPGGPAMPGPMIGGPSMPGPMIGGPAVAVVAPSVYVQPPLQAWQPAGDNPNAGGESDGQGGIFLLFLRSDEGNVFRRRV

SEQ ID NO: 373 - DNA, 990 bp, Brachypodium distachyon
  Bradi3g11520.1
atggatccgcgcccccacaagccgcaagacgaccgctacttccaccaacacgacggcgcgtgccatgccgaccccagtcaaagggctgaatgtaaagcccagggtttggttaccgttcgcaaggttcaaaaggctgaccgtgagagaatgcgaagagacaaattgaatgagcagttccaggaattgggaaccacacttgacccagatcggcccaggaacgataaggctactattcttggtgatacaatccagatgctgaaagatttatcttctcaagtaaacaagcttaaagctgaatactcgtcgctctctgaagaagaacgtgagttgactcaagaaaagaatgagcttcgcgatgagaaagcttcactgaagtctgatattgataatttgaacactcagtatcagcaacgtattagaatgttatacccatggactggaatggagccttctgtggtcattggaccacctccatcatatccctttccagtcccagttcctatacccactggcgcggtgcctatgcatccacagcttcaggcataccccttcttccgaaaccaaactttaggaactgtccccaatccatgtactccatacatggcatacactcaaccctgtcatcctgatcaaccatctaaccagtttagcactccagttccccgttcaagtagtaaccaatctcactctcctgcacaagaccatagaagcaagtcatgtacgctgcagcaaacaagctgtggaaggagaagtgatgattttggtgatgttgcaactgacttggaattaaaaactcctggttcctcagcgccttcacattcagagatagctaagaaggattcctcttcagacttgaaaaagaagaagcaatgcataaatcaaattaatggcagcattcttacagaaggcagcagttcaagcagatgctcttccagtggccctccagatgtctctaatagtgttggggatggttcagttccagatgaccaa

SEQ ID NO: 374 - protein, 330 aa, Brachypodium distachyon
  Bradi3g11520.1 (bHLH domain 40-95)
MDPRPHKPQDDRYFHQHDGACHADPSQRAECKAQGLVTVRKVQKADRERMRRDKLNEQFQELGTTLDPDRPRNDKATILGDTIQMLKDLSSQVNKLKAEYSSLSEEERELTQEKNELRDEKASLKSDIDNLNTQYQQRIRMLYPWTGMEPSVVIGPPPSYPFPVPVPIPTGAVPMHPQLQAYPFFRNQTLGTVPNPCTPYMAYTQPCHPDQPSNQFSTPVPRSSSNQSHSPAQDHRSKSCTLQQTSCGRRSDDFGDVATDLELKTPGSSAPSHSEIAKKDSSSDLKKKKQCINQINGSILTEGSSSSRCSSSGPPDVSNSVGDGSVPDDQ

SEQ ID NO: 375 - DNA, 1029 bp, Oryza sativa
  LOC_Os02g23823.1
atggatccgcgcagcagccaggcgcaagaggacggcttcttccacccacgcgacggcgcgtgccccgccgactccagcggaaagacagaatgtaaaacccagggttcaattgccacgcgcaaggttcaaaaggctgatcgtgagaaaatgcgaagagatagattgaatgagcagttccaggaacttggaagcacacttgatccagatcgacccaggaatgataaggcaactatccttagtgatgcaattcaaatgctgaaagatttgacgtcccaggtgaacaagcttaaagctgaatatacttcactctcagaagaagcacgtgagttgactcaggaaaagaatgagctcagagatgagaaagtttcactgaagtttgaggttgataatctgaatacccagtatcagcaacgaatgcgtgtgctgtacccttggactggaatggagccttctgttgtcattgggccacccctgccatatcctttttcagtcccagtcccagtcccagtccctataccttcaggtgctgttcctatgcacccacagctccaggcatacccttacttccgaaatcaaacttctggaaccgtctccaatccatgcacaccttacatggcatacactcaacccatccatcctcctactgatcaactatctaaccaattcagtgctccagttcagcattcaagtagtaatcgatctcactctatggcccaagactctagaagcaagtcctctgcactgcagcaagtaagttgtagagggaaacatgatgactttgatgacgttgcaactgatctggaactaaaaactcctggttcctcagcccctctacaatcagagattgccaacaaggattcctcttctgacttgaaaaaaaagcagcagttcatacaggaaactaaaggtagttctcttacagaaggcagtagtagttcaagcagatgctcgtccagtggtcctccagatgtctctaacagtattgaaggtggatcagttgctgatgatcaacgatcgacagtacagaca

SEQ ID NO: 376 - protein, 343 aa, Oryza sativa
  LOC_Os02g23823.1 (bHLH domain 40-95)
MDPRSSQAQEDGFFHPRDGACPADSSGKTECKTQGSIATRKVQKADREKMRRDRLNEQFQELGSTLDPDRPRNDKATILSDAIQMLKDLTSQVNKLKAEYTSLSEEARELTQEKNELRDEKVSLKFEVDNLNTQYQQRMRVLYPWTGMEPSVVIGPPLPYPFSVPVPVPVPIPSGAVPMHPQLQAYPYFRNQTSGTVSNPCTPYMAYTQPIHPPTDQLSNQFSAPVQHSSSNRSHSMAQDSRSKSSALQQVSCRGKHDDFDDVATDLELKTPGSSAPLQSEIANKDSSSDLKKKQQFIQETKGSSLTEGSSSSSRCSSSGPPDVSNSIEGGSVADDQRSTVQT

SEQ ID NO: 377 - DNA, 966 bp, Setaria italica
  Si017804m
atggatccgcgcggccaccagccgccggaggacggcttcttccacccgcgtgacgccgacatgagtcaaaggacagagtgcaaagcccaaggtccgtcttccgcacgcaaggtacaaaaggctgatcgtgagaagatgcgaagagataaattaaatgagcagttccaggaattgggaaacacacttgatccagaccgtcccaggaatgataaggcaactatccttggtgacacaatccagatgctgaaagatttgacttctcatgtgaacaagctgaaagctgaatacacgtcactttctgaagaagcacgtgagttgacacaagaaaagaacgagcttagagatgagaaagcttcactgaaatctgaggttgataacttgactaaccagtatcagcaacgaatgcgggtgctgtacccatgggctggaatggaaccttccgttgtcattgggccacctccagcatatccctacccagtcccagttcccataccctctggtgctgtacccatgcatccgcagctgcaggcgtacccctttttccgaagtcaaacttctggaacaatccccaatgcatgcactccttacatggcatacactcaaccctgtcatcctcccactgatcagccatctaaccaacctaatagcccagttgccaattcaagtagtcatcggtctaactctcctgcgcgagactgtagaagcaaatcatctacattgcagcaagcaagctgtggagtgagaagcagtgacgttggtgatgttgcaactgatcttgaactgaaaactcctggttcttcaggtccctcacattcagagatcgctaacaaggattcctcttctgacttgaaaacaaagaagcaatgcataaagcagattaattgtagcagtatcacagaaggcaccagttcaagcagatgctcttccagtggccccccagatgtctctaatagtgttggagatgga

SEQ ID NO: 378 - protein, 322 aa, Setaria italica
  Si017804m (bHLH domain 36-91)
MDPRGHQPPEDGFFHPRDADMSQRTECKAQGPSSARKVQKADREKMRRDKLNEQFQELGNTLDPDRPRNDKATILGDTIQMLKDLTSHVNKLKAEYTSLSEEARELTQEKNELRDEKASLKSEVDNLTNQYQQRMRVLYPWAGMEPSVVIGPPPAYPYPVPVPIPSGAVPMHPQLQAYPFFRSQTSGTIPNACTPYMAYTQPCHPPTDQPSNQPNSPVANSSSHRSNSPARDCRSKSSTLQQASCGVRSSDVGDVATDLELKTPGSSGPSHSEIANKDSSSDLKTKKQCIKQINCSSITEGTSSSRCSSSGPPDVSNSVGDG

SEQ ID NO: 379 - DNA, 858 bp, Arabidopsis thaliana
  AT4G36060.1
atggatcaaccaatgaaaccaaaaacttgctctgaatctgattttgctgatgattcctctgcttcttcttcttcttcttcgggacaaaatctcagaggagctgagatggtggtggaagtgaagaaggaagcagtttgttcccagaaagcagagcgagagaagcttcgtagagataagcttaaggaacagtttcttgagcttggaaatgcacttgatccgaataggcctaagagtgacaaagcctcagttctcactgatacaatacaaatgctcaaggatgtaatgaaccaagttgatagactaaaagctgagtatgaaacactatctcaagagtctcgtgagctaattcaagagaagagtgagctgagagaggagaaagcgactttaaagtctgatatcgagattcttaatgctcaatatcagcatagaatcaaaaccatggttccatgggtacctcattacagttatcatatccccttcgtagccataactcagggtcagtccagttttataccttattcagcctctgtcaatcctctaaccgaacaacaagcatcggttcagcagcattcttcttcttctgccgatgcttcaatgaaacaagattccaaaatcaagccgttagatttggatctgatgatgaacagtaaccattcaggtcaaggaaatgatcaaaaagatgatgttcgtttaaagctcgagcttaaaatccatgcctcttctttagctcaacaggatgtttctggaaaagagaagaaagtaagcttgacaaccactgcaagctcatcgaatagttactcattatctcaagctgttcaagatagttcccccggtaccgtaaatgacatgttgaagcca

SEQ ID NO: 380 - protein, 286 aa, Arabidopsis thaliana
  AT4G36060.1 (bHLH domain 41-100)
MDQPMKPKTCSESDFADDSSASSSSSSGQNLRGAEMVVEVKKEAVCSQKAEREKLRRDKLKEQFLELGNALDPNRPKSDKASVLTDTIQMLKDVMNQVDRLKAEYETLSQESRELIQEKSELREEKATLKSDIEILNAQYQHRIKTMVPWVPHYSYHIPFVAITQGQSSFIPYSASVNPLTEQQASVQQHSSSSADASMKQDSKIKPLDLDLMMNSNHSGQGNDQKDDVRLKLELKIHASSLAQQDVSGKEKKVSLTTTASSSNSYSLSQAVQDSSPGTVNDMLKP

SEQ ID NO: 381 - DNA, 987 bp, Glycine max
  Glyma07g26910.1
atggatcagcgaaagctacgagactcgtccaattcgaaacccgcttcagatgcagcaccccaacacgtcactctcacctctaaccgcttccgcaactctcaagctgctgtgagggagagagagaaagagaagggtgaaggggaaaacgaggatccaagtgcggcacgaaaggttctaaaggcagaccgcgagaagctcagaagggatcgactcaacgaacacttccaagagttgggaaacgcgttagatcctgatagaccaaagaatgacaaggcaactatcctcactgagaccgtccaaatgctaaaggacttaaccgctgaagttaataggcttaaaacagagcataaaacactttctgaagagtcacgcgaactaatgcaagaaaagaatgaactcagagaagagaagacatctcttaaatctgatatagaaaatcttaatgtgcagtatcagcagagagtcagaatcatgttcccatggagtgcaattgacccttcggctgtcattagtcaaccttactcatatccagttcccatacatatcccttctgctccaatctccatccacccatctcttcaaccttttcctttctttggaaatcaaaaccctggccacattcctaatccttgttcaatgtatgtcccatatactactccaactagccaccccccagttgagccgccatcaatgatgtatgcttccacgtcccacgcatcgaaccaaaaagaatccggtagcaagtcaccaggtcatagaaggtccagtggcgctgaaagaagtagcgagactgacgatgtggtcacagagcttgaacttaagatgcctggatcatcatcaacacaacagggttgcacttctggaggaaggaagggcaagatgaaggatagaaccatcataggtgggagtgcttcaagccagtattcttcatctctaggacttcaagatagctccaacagcgtgggtgacatcccgaagactgataat

SEQ ID NO: 382 - protein, 329 aa, Glycine max
  Glyma07g26910.1 (bHLH domain 56-111)
MDQRKLRDSSNSKPASDAAPQHVTLTSNRFRNSQAAVREREKEKGEGENEDPSAARKVLKADREKLRRDRLNEHFQELGNALDPDRPKNDKATILTETVQMLKDLTAEVNRLKTEHKTLSEESRELMQEKNELREEKTSLKSDIENLNVQYQQRVRIMFPWSAIDPSAVISQPYSYPVPIHIPSAPISIHPSLQPFPFFGNQNPGHIPNPCSMYVPYTTPTSHPPVEPPSMMYASTSHASNQKESGSKSPGHRRSSGAERSSETDDVVTELELKMPGSSSTQQGCTSGGRKGKMKDRTIIGGSASSQYSSSLGLQDSSNSVGDIPKTDN

SEQ ID NO: 383 - DNA, 876 bp, Populus trichocarpa
  POPTR_0005s11550.1
atggatcaatggaacacaagaaatgactacgctcaatctttcgttgctgcaacaaccaatatggttccttcaaattcacttcattcattcccacctcgctcttctactcgtcttcagaactcagctcttgaacccaggcagaggcaagaagtggaagtgaaaaatccaattgctgttgcaaaaaaagttcaaaaggcagaccgtgaaaaattgaggagggataatcttaatgagcagtttcttgaattgggtaccacactagacccagataggccaaagaatgacaaggcaaccattttgacagacacaattcaagtgctgaaggatctaacagctgaagtgaacaggctaaaggctgagtgtgcgacactctcagaagaaacccatgagctaatgcaggaaaaaaatgagctcagggaagagaaggcatctttgaaagctgatactgaaaatttaaatgcccagtatcatcaaagtacaagggctatgttcccatgggctgctgttgatccttctgttgtaattcctccttattcttatcaggttcctgtacctgtccctccaggcccaatttccatgcacccgtcattgcagccatttgtcttctttggaaaccagaatcccggtgccattgctagtccttgttcaacatttattccatacccaactgcaaatcacccaaatgatcagccacctgctcagtatgcttctggttcccaattttcaagcaaacaggattccagaaccaagtcaacagatcacgaggggggcagaaataaagaaagatgcaacgattcttctgatgttgcaactgaccttgaacttaaaatgcctggatcatcagcacaacaggtccactctgaagttattaggcat

SEQ ID NO: 384 - protein, 292 aa, Populus trichocarpa
  POPTR_0005s11550.1 (bHLH domain 61-116)
MDQWNTRNDYAQSFVAATTNMVPSNSLHSFPPRSSTRLQNSALEPRQRQEVEVKNPIAVAKKVQKADREKLRRDNLNEQFLELGTTLDPDRPKNDKATILTDTIQVLKDLTAEVNRLKAECATLSEETHELMQEKNELREEKASLKADTENLNAQYHQSTRAMFPWAAVDPSVVIPPYSYQVPVPVPPGPISMHPSLQPFVFFGNQNPGAIASPCSTFIPYPTANHPNDQPPAQYASGSQFSSKQDSRTKSTDHEGGRNKERCNDSSDVATDLELKMPGSSAQQVHSEVIRH

SEQ ID NO: 385 - DNA, 978 bp, Vitis vinifera
  GSVIVT01018777001
atggatcagtggaaagctgatgatttcacgcaatcagttgcaccagagttagccccttccaatcctctttcgttgccctcctccaataatcgcttgccggaagccagacaaagaactgaagtggaagcaaaggattcaattgcagcaagaaaagttcagaaggcagaccgtgaaaagttaaggagggacagactgaatgagcattttcttgagttgggaaacacattagacccagataggcccaagaatgacaaggcaaccatccttgcagatacaattcaaatgctgaaggatttgactgctgaagtcaacagactaaaagttgagtgtgctgcactttctgaagaatctcgtgagctagtgcaggagaagaatgaactaagagaagaaaaggtagctctaaagtctgatattgacaatcttaatgttcaatatcagcaaaggctcagggtcatgtttccatgggctccaatcgatccttctgttgtcatgggtccttcaccctattcttatccagttcctgtgcctgttccttctggtccaattcccatgcatccatctctacagccatttcctttctttggaaatcagaatcctagtggaatccccaatccctgttcaacttttattccatatcaaactcctgctaatcctcctactgaagttccatctgcccaatatgcatctgcttctcatgtgtcaagcaaaccagattccaaaagcaagtcatcagatcgtgaaaggagcagcaacactgaaaaatgcgatgaatctaatgatgtggcaacagaccttgaactaaagacacctggatcatcatcacaacaggatttgctgacaggggaaaagaagggcaaacaatcacaaaggaaggaaagaagtgctacagatggaagctgttcaagcaagtattcttcttctcaagctctccaggacagctcctccaacagtgtgggtgacctcccaaaatctgataag

SEQ ID NO: 386 - protein, 326 aa, Vitis vinifera
  GSVIVT01018777001 (bHLH domain 50-105)
MDQWKADDFTQSVAPELAPSNPLSLPSSNNRLPEARQRTEVEAKDSIAARKVQKADREKLRRDRLNEHFLELGNTLDPDRPKNDKATILADTIQMLKDLTAEVNRLKVECAALSEESRELVQEKNELREEKVALKSDIDNLNVQYQQRLRVMFPWAPIDPSVVMGPSPYSYPVPVPVPSGPIPMHPSLQPFPFFGNQNPSGIPNPCSTFIPYQTPANPPTEVPSAQYASASHVSSKPDSKSKSSDRERSSNTEKCDESNDVATDLELKTPGSSSQQDLLTGEKKGKQSQRKERSATDGSCSSKYSSSQALQDSSSNSVGDLPKSDK

SEQ ID NO: 387 - DNA, 852 bp, Arabidopsis thaliana
  AT3G19860.1
atggacgtttctgctagaaagtcacaaaaagctgggcgcgaaaagttgaggagggaaaaactgaatgagcattttgttgaactgggaaatgtactcgatccagagagacccaagaatgacaaagccacgattctgactgatactgttcagttgttgaaagagctcacatctgaagtcaacaaactgaaatctgagtacaccgcattgacagatgagtcccgcgagttgacacaggagaaaaacgacctgagagaagaaaagacatcgctgaaatcagatatagagaatctcaatcttcaataccagcagagattaaggtcaatgtctccatggggagctgcgatggatcacacagtcatgatggctccaccaccctcctttccataccctatgcctattgctatgcctcccgggtcaatcccaatgcatccatcaatgccatcttacacatactttgggaaccagaaccctagcatgatcccagctccatgtcctacatacatgccctacatgcctcctaatacagtcgttgagcaacaatccgtgcacattccacagaaccccggtaaccgttctcgggaacctagagcaaaggtttcaagagagagcagatctgagaaagcagaggactccaacgaagttgcaacacaactcgaattaaaaacccctggatctacttctgataaggatacattgcaaaggccagagaagacaaagagatgtaagagaaacaacaacaacaactcaatagaagaaagctctcattctagcaagtgttcatcttctccgagcgtacgagaccacagttcttccagtagcgtagctggtggccaaaaacctgatgatgcaaaa

SEQ ID NO: 388 - protein, 284 aa, Arabidopsis thaliana
  AT3G19860.1 (bHLH121, G782, bHLH domain 6-61)
MDVSARKSQKAGREKLRREKLNEHFVELGNVLDPERPKNDKATILTDTVQLLKELTSEVNKLKSEYTALTDESRELTQEKNDLREEKTSLKSDIENLNLQYQQRLRSMSPWGAAMDHTVMMAPPPSFPYPMPIAMPPGSIPMHPSMPSYTYFGNQNPSMIPAPCPTYMPYMPPNTVVEQQSVHIPQNPGNRSREPRAKVSRESRSEKAEDSNEVATQLELKTPGSTSDKDTLQRPEKTKRCKRNNNNNSIEESSHSSKCSSSPSVRDHSSSSSVAGGQKPDDAK

SEQ ID NO: 389 - DNA, 1023 bp, Citrus clementina
  clementine0.9_014901m
atggatcctcagctcaaaaacgaggctgctttggttcaatcaatccccccaccgaacccaaccctcttagaatatcgtcaacctcaaccacctcctgatccgcgcgtgcccaccactcggccccaatccaaatccagccaaaagaatgaaggggaagtcaaagattgtgccgctacgagaaagatgcagaaggctgatcgtgagaagctgcggagggatagacttaatgagcatttcaccgagttgggaaatgcattagatcctgatcgtcccaaaaatgacaaagcaaccattctagctgataccgttcagttgttgaaggatctgacatctcaagttgaaaaacttaaaactgaacatgcagcactgactgaagaatcccgtgagttgacacaagagaaaaatgacctcagggaggagaagttatctcttagatctgagattgagaacctaaatattcagtatcagcagagagtcagggcaatggttccttgggctgctatggatcactcagttatgatggcaccaccttcttatccatatccggtgccaatgccgatgcctcctggggcgatacccatgcatccgcccatgcagccataccccatgtttggaaatcagaatcctggggtcattcctaacccctgttcaacttttgtcccgtatatggctcctaatacactggtggaacaacagtccgcacaatatgcatctgcagttgcacagccaagtggtaggtcccaaggttcagctaaagaagattctggaaacaagtcatcaggggagagcaagattgagaagaatgaggactctaacaatgtcacaactgacctagaattgaaaactcctggatcgacaacagatcaggatcttccatcaggacaaagaaaatccaaaaagtccttgaggaaggagaatagtttcaccaatgggagttcctcaagtaggtgttcctcttctcgtagtgtacaagatagttcatcaaatagcgtagctggtggcagaaaggctgatgatttagga

SEQ ID NO: 390 - protein, 341 aa, Citrus clementina
  clementine0.9_014901m (bHLH domain 60-115)
MDPQLKNEAALVQSIPPPNPTLLEYRQPQPPPDPRVPTTRPQSKSSQKNEGEVKDCAATRKMQKADREKLRRDRLNEHFTELGNALDPDRPKNDKATILADTVQLLKDLTSQVEKLKTEHAALTEESRELTQEKNDLREEKLSLRSEIENLNIQYQQRVRAMVPWAAMDHSVMMAPPSYPYPVPMPMPPGAIPMHPPMQPYPMFGNQNPGVIPNPCSTFVPYMAPNTLVEQQSAQYASAVAQPSGRSQGSAKEDSGNKSSGESKIEKNEDSNNVTTDLELKTPGSTTDQDLPSGQRKSKKSLRKENSFTNGSSSSRCSSSRSVQDSSSNSVAGGRKADDLG

SEQ ID NO: 391 - DNA, 1023 bp, Citrus clementina; identical to SEQ ID NO: 389
  clementine0.9_014926m

SEQ ID NO: 392 - protein, 341 aa, Citrus clementina; identical to SEQ ID NO: 390
  clementine0.9_014926m (bHLH domain 60-115)

SEQ ID NO: 393 - DNA, 849 bp, Glycine max
  Glyma08g15740.1
atggattgttcagctgcaagaaaaacacaaaaggctgaccgtgaaaagttaaggagggatcgactcaatgaacaattcgtagaactgggtaacattttagaccctgataggcccaaaaatgacaaagcaaccattataggtgatacaattcaattgctaaaggacctaacttctcaagttagtaaactcaaagatgaatatgctacgctaaatgaagaatctcgtgagttgactcaggagaaaaatgatctcagggaagagaaggcatctcttaaatctgatattggcaacttgaataatcagtatcagcagcagctgaggaccatgtttccatggactgcaatggatcattcagttatgatggctccaccatcatatccatatccagtgccaatggcagtacctcctggtccaattcccatgcagccataccccttctttgctaatcaacatcctgcagtcatctccaacccctgttcaacttatgttccttatttagcccccaatacgattgttgaacaacaatccacccaatacgtatcccctccactacatccttgtggtcggtccaatgtgtcaggaaaacaagagtccaagagcaagtcatccagggagagcaaggctgaaaagaatgaggattctaatgatgtcactacagacctcgagttgaagactcctgggtcttctgctgatcaggttagtgttgttttccaaggatatcccatgatagaagatgcattggattcaagttgcgtgtgtctctggtttgcaggatttatcatccagacaaagaaaatccagcaagttgtcaaggagggaaagcagttgcacagaaggaagttcattagg

SEQ ID NO: 394 - protein, 283 aa, Glycine max
  Glyma08g15740.1 (bHLH domain 7-62)
MDCSAARKTQKADREKLRRDRLNEQFVELGNILDPDRPKNDKATIIGDTIQLLKDLTSQVSKLKDEYATLNEESRELTQEKNDLREEKASLKSDIGNLNNQYQQQLRTMFPWTAMDHSVMMAPPSYPYPVPMAVPPGPIPMQPYPFFANQHPAVISNPCSTYVPYLAPNTIVEQQSTQYVSPPLHPCGRSNVSGKQESKSKSSRESKAEKNEDSNDVTTDLELKTPGSSADQVSVVFQGYPMIEDALDSSCVCLWFAGFIIQTKKIQQVVKEGKQLHRRKFIR

SEQ ID NO: 395 - DNA, 963 bp, Glycine max
  Glyma15g29630.1
atgattaccccccttgaagtaaatgagcctgaagttgaaccaatggattgttcagctgctagaaaaacacaaaaggctgaccgagaaaagttaaggagggatcgaatcaatgaacagttcgtagaattgggtaacattttagaccctgataggcccaaaaatgacaaagcaaccattctgtgtgatacaattcaattgctgaaggacctaatttctcaagttagtaaactcaaagatgaatatgctatgctaaatgaagaatctcgtgagttgactctagagaaaactgatctcagggaagagaaggcttctcttaaatcagatattgacaacttgaataatcagtatcagcagcagctcaggaccatgtttccatggactgcaatggagcattcagttatgatggctccatcatcgtatccatatccagtgccaatggcagtacctcctggtccaattcccatgcagccataccccttctttgctaatcaacatcctgcagtcatctccaacccctgttcaacttatgttccttatttagcccccaataccattgttgaacaacaatccaccctgtacgtatcccctccacttcatccaggtgctcggcccaatgtgtcaggaaaacaagagtccaagagcaagtcatccagggagagcatggctgaaaagaatgaggaatctaatgatgtcactacagaccttgagttgaagactcctgggtcttctgcagatcaggttagtgttgttttccaaggatatcccatgatagaagatgcatcggattcaagttgtgtgtgtgtgtctggtttgcaggatttatcatctggacaaagaaaatctagcaagttgtcaaggagggaaagcagctgcactgaatggagttcattaggtaggtgttcttcttgtagcgttcaggacagctcatcaagcagtgtggtggcgagcagaaaggataacgaa

SEQ ID NO: 396 - protein, 321 aa, Glycine max
  Glyma15g29630.1 (bHLH domain 21-76)
MITPLEVNEPEVEPMDCSAARKTQKADREKLRRDRINEQFVELGNILDPDRPKNDKATILCDTIQLLKDLISQVSKLKDEYAMLNEESRELTLEKTDLREEKASLKSDIDNLNNQYQQQLRTMFPWTAMEHSVMMAPSSYPYPVPMAVPPGPIPMQPYPFFANQHPAVISNPCSTYVPYLAPNTIVEQQSTLYVSPPLHPGARPNVSGKQESKSKSSRESMAEKNEESNDVTTDLELKTPGSSADQVSVVFQGYPMIEDASDSSCVCVSGLQDLSSGQRKSSKLSRRESSCTEWSSLGRCSSCSVQDSSSSSVVASRKDNE

SEQ ID NO: 397 - DNA, 825 bp, Glycine max
  Glyma12g02740.1
atggattgtacagctgcaaggaaaacacaaaaggctgaccgagaaaagctaaggagggatcgattcaatgtacagtttgtagaactgggtaacattttagaccctgataggcccaaaaatgacaaagcaaccattctaggtgatacaattcaattgctaaaggaccttacttctgaagtcagtaaacttaaagatgaatatgctactctaaatgaagaatcttgtgagttggctcaggagaaaaatgaactcagagaagagaaggcttctcttaaatcggatattttgaagttgaataatcagtatcagcaacagctcaggactgtgtctccatggactgcaacggatcgttcaataatgctagctccaccatcatatccatatccagtgccaatgccaatacctcctgctcctattgccatgcagccataccccttctatgctaatcaacattctgcaatcatccctaacccttgttcaacatttgttccttatttagtccccaatacccttactgaacagcgatccacccagtacatgtcgccacctgttcatccaggttttcggtcccatgtgtcaggaaaacaagagtccagaaacaaatcatccaaggagagcaaggctgaaaaacatgaggattctaatgatgtcactctgactcctgggtcttctgctgatcaggatttatcatctggacaaagaaaatctagcaagttgtcaaggaaggaaagcagttgcactgaagtgagttctttagataggtgctctttgtcttgtagcgttcaggatagttcatcaagtagtgtagttcacaagcacaaaggc

SEQ ID NO: 398 - protein, 275 aa, Glycine max
  Glyma12g02740.1 (bHLH domain 7-62)
MDCTAARKTQKADREKLRRDRFNVQFVELGNILDPDRPKNDKATILGDTIQLLKDLTSEVSKLKDEYATLNEESCELAQEKNELREEKASLKSDILKLNNQYQQQLRTVSPWTATDRSIMLAPPSYPYPVPMPIPPAPIAMQPYPFYANQHSAIIPNPCSTFVPYLVPNTLTEQRSTQYMSPPVHPGFRSHVSGKQESRNKSSKESKAEKHEDSNDVTLTPGSSADQDLSSGQRKSSKLSRKESSCTEVSSLDRCSLSCSVQDSSSSSVVHKHKG

SEQ ID NO: 399 - DNA, 978 bp, Populus trichocarpa
  POPTR_0004s17540.1
atggatccattcactgacttcaatcctccgcctcctcctcctgtcccgaggcacgtgccacccactcgccccaaccccaatcccaaatccagcgaggcagagattaaagatagtgtatctgctaggaaaattcaaaaggcggaccgagaaaaattgaggagggatagattgaatgagcattttgttgaattggggaataccctagatcctgatagacctaaaaatgacaaagcgaccattctagctgacacaattcagctgctgaaggatttgacatctcaagttgacaaactcaaggctgagtatgctacactgagtgaagaatctcttgagttgacccaagagaaaaatgatctcagagaagagaaggcatctcttaaatcggatattgagaatcttaatattcagtgtcagcaacggctcagggctccatacccatggcctgctatggatcactcatttatgatggccccaccttcatatccctttcccatgccagtgccaatgcctccaggggcaattccattgcattcatccatacagccatatcccttttttggaaatcagaatcctgcagtcattcataacccatgttcaacttttgttccatgtatggcccctaataccttggttgatcagcagtccgcccagcatgtttcttctctttcacagcctgccagtcgatcccatgtttcaggcgaacaagatctgaagaataaaccttcaggggagtgcaagattgagaaaagcgaaggttctaatgatgttaccacggaccttgaattgaagactccaggatctacagcagatcaggatttatcttcaggacaaagaaagtccaaaaaatcccagaggaaggaaagcagtgttacagaaaggagttcttcaagtaggtgttcttcctctcacagtgtacaggatagctcatccaacagtgttgttgacagcacaaagcacgatgatttggacaagttagaa

SEQ ID NO: 400 - protein, 326 aa, Populus trichocarpa
  POPTR_0004s17540.1 (bHLH domain 42-97)
MDPFTDFNPPPPPPVPRHVPPTRPNPNPKSSEAEIKDSVSARKIQKADREKLRRDRLNEHFVELGNTLDPDRPKNDKATILADTIQLLKDLTSQVDKLKAEYATLSEESLELTQEKNDLREEKASLKSDIENLNIQCQQRLRAPYPWPAMDHSFMMAPPSYPFPMPVPMPPGAIPLHSSIQPYPFFGNQNPAVIHNPCSTFVPCMAPNTLVDQQSAQHVSSLSQPASRSHVSGEQDLKNKPSGECKIEKSEGSNDVTTDLELKTPGSTADQDLSSGQRKSKKSQRKESSVTERSSSSRCSSSHSVQDSSSNSVVDSTKHDDLDKLE

SEQ ID NO: 401 - DNA, 969 bp, Populus trichocarpa
  POPTR_0009s13220.1
atggatccattcaccgacttcaatcctcctcctgctgtcccgcggcatgtgccgtcgactcaccccgacccgatatctagcgaggcagagcttaaagatagtgtagctgctaggaaaattcaaaaggcggaccgtgaaaaattgaggagggatagattgaatgagcattttgttgaattggggaataccctagatcctgatagacccaaaaatgacaaagcaaccattctagctgacacagttcagctgctgaaggatttgaattcaaaagttgacaaactcaaggctgagcatgctgcactgagtgaagagtctcgtgagctgacgctagaaaaaaatgaccttagagaagagaaggcatctcttaaatcagatgttgagaatcttaatattcagtgtcagcaacagctcagggctacatacccatgggctgccatggatcactcggttatgatggccccaccttcctatccctttcccatgccagtgccaatgcctcccggaccaattccaatgcatccgtccatgcagccataccccttttatggaaatcagaatcctgcagtcattcataacccttgttcaacttttgttccatacatagcccctaataccctgtttgatcagcagtccgcccagcatgtttcttctctagcacagtctgccagtcgatcccacgtttcagtgaaacaggattcaaagaataaatcttcaggagagagcaaggttgagaaaagcaaggattctaatgatgttaccacagacctggaattgaagactccgggatccacagcagatcaggacttaacttcagtacaaagaaaatctaaaaaatccacggggaaggaaagcagtgttacaaaagagagttcttcaagtagatgttcttcttctcatagtgtacaggatagttcatccaacagtgtagttggcaacacaaaggtcgatgatctagacaaacgagagaat

SEQ ID NO: 402 - protein, 323 aa, Populus trichocarpa
  POPTR_0009s13220.1 (bHLH domain 38-93)
MDPFTDFNPPPAVPRHVPSTHPDPISSEAELKDSVAARKIQKADREKLRRDRLNEHFVELGNTLDPDRPKNDKATILADTVQLLKDLNSKVDKLKAEHAALSEESRELTLEKNDLREEKASLKSDVENLNIQCQQQLRATYPWAAMDHSVMMAPPSYPFPMPVPMPPGPIPMHPSMQPYPFYGNQNPAVIHNPCSTFVPYIAPNTLFDQQSAQHVSSLAQSASRSHVSVKQDSKNKSSGESKVEKSKDSNDVTTDLELKTPGSTADQDLTSVQRKSKKSTGKESSVTKESSSSRCSSSHSVQDSSSNSVVGNTKVDDLDKREN

SEQ ID NO: 403 - DNA, 987 bp, Vitis vinifera
  GSVIVT01024084001
atggatcatcagaaccccgaagctttctgccagtccactcactacccacctcctgacccgcgtgtctcctccactcgctcacacccagactccagcaagaggtctgagggggaattcaaggattttgttactgcaaggaaggttcagaaggctgatagggagaaattgaggagggatcggttgaatgagcagtttatagagttgggaaatgccttagatcctgataggcccaaaaatgataaagcaaccattctttctgatacaattcaattgctcaaggacttgacagcccaagttgagaaactgaaagctgagaatgcatcactaaatgaagaatcccgtgagttaactcaggagaagaatgatctcagagaagagaaggcatccctcaaatcggctactgagaaccttaatgttcagtatcaacagagactcagagctatgttcccatggtctgccattgatccctcagttgttgtaagtccaccttcttacccgtttccagtgccagtcccagtgcctatccctacaggttcaattcccatgcatccatctatgcagccatatcctttctttggaagtcagaacactgggatcattcctaacccctgttcgacttttgttccatactttactccaaataccctgattgaaccacagtcaacacaacatgtatctccacctatgcaaccaggcagtacgtccaacatttcaagcaaacaggattccaagaatgagtcaccaggggagagcaagagtgaaaaaggtgaagattctactgatgttgcaacagacctgcagctcaagacacctggatctaaatctgatcaggaagtatcatcagggcaacagcaacacaaacccaagagatctctgagtaaggaaaagaacagtacagaagggagctcttcaagtaggtgttcttcgtctcctagtgtacaggatagctcctcaaatagtgtagttggtggcagaaaggctgacgac

SEQ ID NO: 404 - protein, 329 aa, Vitis vinifera
  GSVIVT01024084001 (bHLH domain 46-101)
MDHQNPEAFCQSTHYPPPDPRVSSTRSHPDSSKRSEGEFKDFVTARKVQKADREKLRRDRLNEQFIELGNALDPDRPKNDKATILSDTIQLLKDLTAQVEKLKAENASLNEESRELTQEKNDLREEKASLKSATENLNVQYQQRLRAMFPWSAIDPSVVVSPPSYPFPVPVPVPIPTGSIPMHPSMQPYPFFGSQNTGIIPNPCSTFVPYFTPNTLIEPQSTQHVSPPMQPGSTSNISSKQDSKNESPGESKSEKGEDSTDVATDLQLKTPGSKSDQEVSSGQQQHKPKRSLSKEKNSTEGSSSSRCSSSPSVQDSSSNSVVGGRKADD

SEQ ID NO: 405 - DNA, 999 bp, Solanum lycopersicum
  Solyc01g111130.2.1
atggatcaattcaaccatggcggcctctatcaatcgaatcagcttccaaatcattgtttaacagagttaaatcagcttccttctgatgtttccacgcctcccaatggcttgctttctgaatcaagcaaacaaaaacctgaggcagaactcaaagactctattgctgcaagaaaagtgcagaaggcagatcgagaaaaattaaggagggaccgcttgaacgagcagttcatggaattaggaaagacccttgatcctgataggcctaaaaatgacaaagcatccatcctaagtgataccgttcaaatactgaaggatttgactgctcaggtcagcagattaaaatctgagtatgctgcacttactgatgaaagccgtgagttgacccaggagaaaaatgatctcagagaagagaaggcatctcttaaatctgatattgagagccttaatgcccaatatcaacaaagaatgaggactatgtatccatgggccgggatggatcattccatggtcatgcatccgccttcatatccgtatccaatgcccgttccaattccaactggaccagttcctatgcatccacctctgcagccctatcctttcttcggcaatcataatcctgcagttgttccaaacccttcatcttttgttcaatacatgactcccaatacattgattgaacagcaaccgactcagtatatgtctccaattatacaaccaggtagtatgaccaggcaagaatccaggaacaagtcatcagatcaaggagagagcagaattgagaaaagtgaagattccaatgaagtggcaacagatttagagcttaagacacctggatctacatccgagcaggacctttcatctggacaaaagaaatccagaaagttgccaaggaaggataacagcttcacggatggaagttcctcaagtaaatgttcatcatcccatagtgtacatgctgtttcttcaaatagtgtagttaggggaacaaagactggtgat

SEQ ID NO: 406 - protein, 333 aa, Solanum lycopersicum
  Solyc01g111130.2.1 (bHLH domain 57-112)
MDQFNHGGLYQSNQLPNHCLTELNQLPSDVSTPPNGLLSESSKQKPEAELKDSIAARKVQKADREKLRRDRLNEQFMELGKTLDPDRPKNDKASILSDTVQILKDLTAQVSRLKSEYAALTDESRELTQEKNDLREEKASLKSDIESLNAQYQQRMRTMYPWAGMDHSMVMHPPSYPYPMPVPIPTGPVPMHPPLQPYPFFGNHNPAVVPNPSSFVQYMTPNTLIEQQPTQYMSPIIQPGSMTRQESRNKSSDQGESRIEKSEDSNEVATDLELKTPGSTSEQDLSSGQKKSRKLPRKDNSFTDGSSSSKCSSSHSVHAVSSNSVVRGTKTGD

SEQ ID NO: 407 - DNA, 948 bp, Zea mays
  GRMZM2G114444_T02
atgtcttcgtcggggcctttgccggcgaccggaacccaccacggcagtcaaagggcagagtgtaaatcccagggttccacttctgcacgcaaggtacaaaaggctgatcgtgagaagatgcgaagagataaattaaacgagcagttccaggacttgggaaatgcacttgatccagaccgtcccaggaacgataaggcaactatacttggtgacacaatccagatgctgaaagatttgactactcaggtgaacaagctgaaagctgaatacacgtcactttctgaagaagcgtgtgagttaacacaagaaaagaatgagcttagagatgagaaagcttcactgaaatctgaggttgataatttgaataatcagtatcagcaacgaatgcgggtgctatacccatgggttggaatggagccttctgttgtcatggggccacctcctgcatatccctacccagtcccagttccaataccctctggtgctgtacccatgcatccgcagttgcaaacataccacttcttccacagtcaagcttctggaaccatccaaaacacatgcatcccttacatggcatatacacaaccctgccatcctcccactgatcagccgtctaaccaacttaatactccagttgcccattcaagtagtcataggtctaactctccagctcaagactgtagaagcaagtcatctacattgcagcaaccaagctgtggagtgagaagcagtgatgctggtgatattgctactgatctggaattgaagactcctggttcttcatgtcaatcacatgcagagattgcttacaacgattcctcttcggatttgaaaacaaagaagcattgcataaagcagattaatgattgcactctcactgaaagcagtagttcaagcagatgctcttccaatggtcccccagatgtttctaatagtgctattgatgaa

SEQ ID NO: 408 - protein, 316 aa, Zea mays
  GRMZM2G114444_T02
MSSSGPLPATGTHHGSQRAECKSQGSTSARKVQKADREKMRRDKLNEQFQDLGNALDPDRPRNDKATILGDTIQMLKDLTTQVNKLKAEYTSLSEEACELTQEKNELRDEKASLKSEVDNLNNQYQQRMRVLYPWVGMEPSVVMGPPPAYPYPVPVPIPSGAVPMHPQLQTYHFFHSQASGTIQNTCIPYMAYTQPCHPPTDQPSNQLNTPVAHSSSHRSNSPAQDCRSKSSTLQQPSCGVRSSDAGDIATDLELKTPGSSCQSHAEIAYNDSSSDLKTKKHCIKQINDCTLTESSSSSRCSSNGPPDVSNSAIDE

SEQ ID NO: 409 - DNA, 753 bp, Arabidopsis thaliana
  AT1G60250.1
atggctcaagtttgtcacacatgtagacatgtaacagccgtgatccattgtgttacagaagctcttaacttctgccttacatgtgacaaccttcgccatcataataacatacatgcagaacacgtacgttaccaactttgcgataactgctcgatgtatccgtctatacttttctgttatgaggacgggatggttctttgtcaatcatgttattcgcaccattacaattgtgccactaatggccatcaaactcaagtcgtcttcgctaacatgaataatcaacaccatgatcatgcacatatgcctcatgtggttcaccataacaataacaataatcatcagcagcagcatgtgggtggtcaccaaagaagagcagagatgtttgagaggagctgccacggggataacaattgcgagagatggatgtttgcaatgagatgtgagttatgcgtagcttcgaattcaaatgctgttgtttattgtcctacacacaaccagattctatgcgatagttgcgaccggatgattcacagtcacgaggacgcggtgccgccgcattcgaggtgtaagctttgcgtaatctgcaagagaccttctcgccgttttctcattggcggctatcagtttaatttcccaccggttcatcctcctgcggcagaggggattccagttacgcccccaacagaactacctcaacaagatattaattatgattatctagatgatgttgatgatttttcttggtttggtagg

SEQ ID NO: 410 - protein, 251 aa, Arabidopsis thaliana
  AT1G60250.1 (BBX26, G1486, B-box (BBX) domain 5-41)
MAQVCHTCRHVTAVIHCVTEALNFCLTCDNLRHHNNIHAEHVRYQLCDNCSMYPSILFCYEDGMVLCQSCYSHHYNCATNGHQTQVVFANMNNQHHDHAHMPHVVHHNNNNNHQQQHVGGHQRRAEMFERSCHGDNNCERWMFAMRCELCVASNSNAVVYCPTHNQILCDSCDRMIHSHEDAVPPHSRCKLCVICKRPSRRFLIGGYQFNFPPVHPPAAEGIPVTPPTELPQQDINYDYLDDVDDFSWFGR

SEQ ID NO: 411 - DNA, 1068 bp, Arabidopsis thaliana
  AT1G68190.1
atgttatgtataataataattgagaatatggaaagagtatgtgagttttgtaaagcgtatagagcagtggtttattgtatagctgatacagcaaatctttgtttaacatgtgatgcaaaggttcattcagctaattcactctcgggacggcatttacgtacggttttatgtgattcttgtaagaatcagccttgtgttgttcgatgttttgaccataaaatgtttctttgccatggatgtaatgataagtttcatggtggtggctcttctgagcatcgtagaagggatttgaggtgttatacgggttgtcctcctgctaaagatttcgcggttatgtggggttttcgagttatggatgacgatgatgatgtttcgttagagcaatcttttcgaatggttaaacctaaggtgcaaagagaaggtggttttatcttggaacagattcttgaattggagaaggttcagctcagggaagagaatggtagttcttccttgacagaacgaggtgatccatctccattggagcttcctaagaaacccgaagaacagttaatcgatcttccgcagaccggaaaagagctggttgttgatttttcacacttgtcctcatcttccacacttggtgattccttttgggaatgcaaaagtccatacaataagaacaatcagttgtggcatcaaaatatacaagacattggagtatgtgaagatacaatctgcagtgacgatgacttccaaatacctgacattgatctcactttccggaactttgaagagcaatttggagctgatcctgagccaattgcagatagtaacaacgtgttctttgtttcttcccttgacaaatcacatgagatgaagacattttcttcttcattcaataatcccatatttgcacctaaaccagcttcatcaactatctcattctcaagcagtgaaaccgataacccttatagtcactcagaggaagtaatctcattttgtccctccctctctaacaatacacgtcaaaaggtcatcacaaggctcaaggagaagaagagagcaagagtggaggagaaaaaagct

SEQ ID NO: 412 - protein, 356 aa, Arabidopsis thaliana
  AT1G68190.1 (BBX domain 14-51)
MLCIIIIENMERVCEFCKAYRAVVYCIADTANLCLTCDAKVHSANSLSGRHLRTVLCDSCKNQPCVVRCFDHKMFLCHGCNDKFHGGGSSEHRRRDLRCYTGCPPAKDFAVMWGFRVMDDDDDVSLEQSFRMVKPKVQREGGFILEQILELEKVQLREENGSSSLTERGDPSPLELPKKPEEQLIDLPQTGKELVVDFSHLSSSSTLGDSFWECKSPYNKNNQLWHQNIQDIGVCEDTICSDDDFQIPDIDLTFRNFEEQFGADPEPIADSNNVFFVSSLDKSHEMKTFSSSFNNPIFAPKPASSTISFSSSETDNPYSHSEEVISFCPSLSNNTRQKVITRLKEKKRARVEEKKA

SEQ ID NO: 413 - DNA, 1395 bp, Populus trichocarpa
  POPTR_0008s12410.1
atggagaaagtttgcgaattctgcatggccttgaggccagtcgtttactgtaacgctgatgcagcatatctttgcctttcctgcgatgcaaaggtccattcagctaatgcactttttaaccggcatctccgtaccctcctatgtgactcatgcaggaaccatccagcttacgctcagtgtttggaccaccggatgctgatgtgtcttggctgtgatcggtgcctgcatgaggtctcctcccaccatcagaaacggctagtcagtagctacttaggatgcccttctgctaaagattttgcatcactttggggttttgaatttggggatttggataaaagtattgttaaagatcaactagtttccacgccatgctcttcatctgtgcagcctagtgcatcaaaatttgacattccagggaagtcttgccaacaaattggacggtcttcaagaaaatctagagtgattcactcaactttggtctctggtgcagagtctgatgttggatcaggcaatcaacgacctgagttatcgtacaaaggtccacagcaggaaagtacctgctttattctggaacagattcttgatttgaaaaggcttcagctcactgatgtcaacaacaatactcctatgaaacgtggtcaagaacaaaaaaacatttctacctcaaagaagcttgactacaatctcaatcattcacaacattctcaagatcttgttaccattcttcaacaagctgactgccaacgtcagggtctaaaagtggattctttgcctttgccattttctcagccagaacatttacctttcttttcaactgccgcaaatgctttgcctggagaatccttttggccatgcaaaagtccaatagagaatagtcagttgtggtctcaaaatatgcaagaccttggggtttgtgaagacattatttgccatgatgatgattatatcattcctgatgtggataaaacattttgcaactttgaagaattctttgggggtgatcaagatccaattggagcatttcttgatgagaatgatttctcatgctccttcattgagaaggatatgcctcctgagaaatccaataacagtgatggaagagcaaggaaggatgcttctgttacttcatctgtttacataagctgctctgttcacattgacaatgacaaggatccttccaaccaagcttataactttcctggaagtcttgatcctgctcagacaatcaggtctccttattcaagatactccatttcaagtcatgatgctgaaagcaggagtaatgaatatcttgacagtgaactttcaccatatatatctaatggtgaagcatcatgctattcacccgaccttgaggatgcacatacagaggcccgagaaaatgcaaaaaggctc

SEQ ID NO: 414 - protein, 466 aa, Populus trichocarpa
  POPTR_0008s12410.1 (BBX domain 5-42)
MEKVCEFCMALRPVVYCNADAAYLCLSCDAKVHSANALFNRHLRTLLCDSCRNHPAYAQCLDHRMLMCLGCDRCLHEVSSHHQKRLVSSYLGCPSAKDFASLWGFEFGDLDKSIVKDQLVSTPCSSSVQPSASKFDIPGKSCQQIGRSSRKSRVIHSTLVSGAESDVGSGNQRPELSYKGPQQESTCFILEQILDLKRLQLTDVNNNTPMKRGQEQKNISTSKKLDYNLNHSQHSQDLVTILQQADCQRQGLKVDSLPLPFSQPEHLPFFSTAANALPGESFWPCKSPIENSQLWSQNMQDLGVCEDIICHDDDYIIPDVDKTFCNFEEFFGGDQDPIGAFLDENDFSCSFIEKDMPPEKSNNSDGRARKDASVTSSVYISCSVHIDNDKDPSNQAYNFPGSLDPAQTIRSPYSRYSISSHDAESRSNEYLDSELSPYISNGEASCYSPDLEDAHTEARENAKRLG

SEQ ID NO: 415 - DNA, 1314 bp, Glycine max
  Glyma10g41540.1
atggagaaggtttgtgaattctgcacagctttgaggccacttgtttactgtaaggctgatgcagcatatctttgtctttcctgtgatgcaaaggtgcatttagcaaatgcagtgtccggccggcacctccggaacctcgtgtgtaactcatgcggataccaccttgcttatgttctgtgtttggaacacaaaatgttgatatgtcgtgactgtgaccaaaagttgcacaacatttctttgccacataagaaacgagctatcagaagtttcatgggttgcccttctgctaaagactttgcagcactctggggggttgaattgaatgagattgaaaacagtgccagtcaggatcagtttgattcagtttcttgtgtttctgcagatttaaatgttgcacaagtttcaggaaagcctggcattcaaactgaggtcccttcaatgctatctggggccaaacttgatgggggaggatcaaccagtcaacaaggtcagatattgtatagtgatcaaaagcgtcaaacgattctgcagcagattattgattttaaatggcttcaacaaaatgaggagattgattattctgcaaagatcaataggctacaagaaaaagattcatctccttcagtatatcagactcttaagaaattggacgacaaattcaatgagcaagcacaaaattcccaagatcttgctactaatgttctggaaaaagactgtcccattatggagctgaatcctgaaactttgccttctacgttttctcaacttgacaatttatattcttcttcaactatcgatcttcccttgcatggagaattgttctggacatgcaaaagtccacttcaaagtaatcagttgtggtcccaaaatattcaagaccttgggatatgcaaagaacttgtttgtcaagatgattttaacatccctgatgttgacttaactttccaaaactatgaggaactatttggaggagatcaagatccaattagaatactgcttgatgatcaagatgtctcctgctcttctttagagaaggataagtcagttgacaagtcagttattgacaatccaagtgcaatggaggaatcttctgcagctgcgtccattactatctcccaatctgatcttgacaacaaggatatgaatcctctcagccagtactgtccaagaagcatggatcctgctcatgcaattcgaccatttgattcaactataccattctctgttctgagattcaatgaggaaagcagttgcacaaaccatgatgacagtgccctttctccctacagtgaagggagggcttattcaggtagt

SEQ ID NO: 416 - protein, 438 aa, Glycine max
  Glyma10g41540.1 (BBX domain 5-42)
MEKVCEFCTALRPLVYCKADAAYLCLSCDAKVHLANAVSGRHLRNLVCNSCGYHLAYVLCLEHKMLICRDCDQKLHNISLPHKKRAIRSFMGCPSAKDFAALWGVELNEIENSASQDQFDSVSCVSADLNVAQVSGKPGIQTEVPSMLSGAKLDGGGSTSQQGQILYSDQKRQTILQQIIDFKWLQQNEEIDYSAKINRLQEKDSSPSVYQTLKKLDDKFNEQAQNSQDLATNVLEKDCPIMELNPETLPSTFSQLDNLYSSSTIDLPLHGELFWTCKSPLQSNQLWSQNIQDLGICKELVCQDDFNIPDVDLTFQNYEELFGGDQDPIRILLDDQDVSCSSLEKDKSVDKSVIDNPSAMEESSAAASITISQSDLDNKDMNPLSQYCPRSMDPAHAIRPFDSTIPFSVLRFNEESSCTNHDDSALSPYSEGRAYSGS

SEQ ID NO: 417 - DNA, 1269 bp, Glycine max
  Glyma20g25700.1
atggagaaggtttgtgaattctgcacagctttgaggccacttgtttactgtaaggctgatgcagcatatctttgtctatcctgtgattcaaaggtgcatttagcaaatgcagtgtctggtcggcacctccggaactttgtgtgccactcatgcggataccatcttgcttatgttctgtgtttggaacataaaatgttgatctgtcgtgactgtgatcaaaagttgcataacatttctttaccacataagaaacgagctatcagaagtttcatgggctgcccttctgctaaagactttgcagcactctgggggtttgaatcgaatgagattgaaaacaatttgaatgttgcacaagtttcaggaaagcctggcattcaaactgggatcccctcaatgccatctggagccaaatttgatgggggaggatcaaccagtcaacaaggtcagatattgtacagtgatcaagagcgacaaactattctgcagcagattattgatttaaaaatgcttcaacaaaatgaggacattgattatcttgcaaagatcaataggctacaagaaaaagatttatctccttcagtatatcacactcttaagaaattggacgacaaattcaatgagcaagcacaaaagtcccaggatcttgctactaatgttctggaaaaagactgtcccactgtggagctgaatcctgaaactttgccttctacgttttctcaatttgacaatttatattcttcttcaattatcgatcttcccttgcatggagagttgttctggacatgccgaagtccacttcaaagtaatcagttgtggtcccaaaatattcaagaccttgggatatgcaaagaacttgtttgtcaagacgattttaacatccctgatgttgacttaactttccaaaactttgaggaactatttggaggagatcaagattcaattagaatactgcttgatgatcaagatgtctcctgctcttctttagagaaggataagtcagttggcaagtcagatattgacaatccaagtgcaatggaggaatcttctgcagctgcgtctattactatctcccaatctgatcttgacaataaggatatgaatcctctcagccagtaccgtccaagaagcatggatcccgcccttgcaattcgaccatttgattcaaccataccattctccgttttgagattcaatgaggaaagcagttgcactagccatgatgacagtgccctttctccctacagtgaaaggaaggcttattcaggtagt

SEQ ID NO: 418 - protein, 423 aa, Glycine max
  Glyma20g25700.1 (BBX domain 5-42)
MEKVCEFCTALRPLVYCKADAAYLCLSCDSKVHLANAVSGRHLRNFVCHSCGYHLAYVLCLEHKMLICRDCDQKLHNISLPHKKRAIRSFMGCPSAKDFAALWGFESNEIENNLNVAQVSGKPGIQTGIPSMPSGAKFDGGGSTSQQGQILYSDQERQTILQQIIDLKMLQQNEDIDYLAKINRLQEKDLSPSVYHTLKKLDDKFNEQAQKSQDLATNVLEKDCPTVELNPETLPSTFSQFDNLYSSSIIDLPLHGELFWTCRSPLQSNQLWSQNIQDLGICKELVCQDDFNIPDVDLTFQNFEELFGGDQDSIRILLDDQDVSCSSLEKDKSVGKSDIDNPSAMEESSAAASITISQSDLDNKDMNPLSQYRPRSMDPALAIRPFDSTIPFSVLRFNEESSCTSHDDSALSPYSERKAYSGS

SEQ ID NO: 419 - DNA, 1425 bp, Solanum lycopersicum
  Solyc04g007470.2
atggaaatggagaaagcatgtgaattttgcatgttattgaagccagtggtgtattgtgaagctgatgcagcacatctttgtttatcttgtgatgctaaagttcattcagctaatgccctctctaatcgtcatcctcgtactcttgtctgcgagtgttgtggacacaaccctgcttatattcgatgttctgatcatcaaacgttcatgtgtcgtgactgtgaccgatgccatcatgatctctcttctcaacaccagagaaaagtgatcactagttacatgggatctccttctgctaaggatttggcagcattatggggatttggcttgaaagatttggaaaatgccactccaccagatcagttcatctcaacatcgaatggtaaagcgaatggagttaaggtcatttcaaaaaaatttaaacggtctcactcatcaccagggggctcttccttagcttctgaactcgacttcacaggtctcgttgtttctcctgaatcagaagtgggatcaactagttactacactaaggtgttaagcttgcgtaaacggagagagaatacttctcttattctacagcagattcttgacttggaaagacttcagctgactgagggcagtaacaatttaacaagtggagaaagtcgaaataatgtttcttcattgaaaaattgtacatcatggaatatgcataacaaatttgattgcttgcagagttcacttgatcttggccctgaacttcaggattggggcagtactcatgaaagtccagttgatgaatcgtttccattaccgttgcctgatggtgattcgttttgggaatgtaaaagtccggttcagagtagtcagctttggcctcaaaatctgcaagatctaggagcttatgctgaactagaacgtttcgataattccaatatgcctgatgttgatttgaccttccaaaactttgaagaactcttcggtgaggatcagtatctgaacaacactcttctcgaggaggatatgacatgttcatctatggagaatgattcatcgatcgatagatcagattacagctacgttaagaaggacatatcaacagcttcatcggttcgtacaggacattcaactcactttggccaagcccacggtgagcacattcccacgatcaaggactgtcctccgcctataagaacaaacttttcctccttgtccttctcagcatcaaggctgagcagtgaaagcagtggtaacgagtacgtggattcaccagctgccaacgatcaggaggtttcatgtaattcacagatggacagtaaaaagaaggctaggctgtatgagaaacaagctcggaatacacctcgaagagctaggactaactttaagaagcagcatgtcctgaaggcacattgctatgaaacagatgcacttaatatgtcacgaagcttt

SEQ ID NO: 420 - protein, 475 aa, Solanum lycopersicum
  Solyc04g007470.2 (BBX domain 7-44)
MEMEKACEFCMLLKPVVYCEADAAHLCLSCDAKVHSANALSNRHPRTLVCECCGHNPAYIRCSDHQTFMCRDCDRCHHDLSSQHQRKVITSYMGSPSAKDLAALWGFGLKDLENATPPDQFISTSNGKANGVKVISKKFKRSHSSPGGSSLASELDFTGLVVSPESEVGSTSYYTKVLSLRKRRENTSLILQQILDLERLQLTEGSNNLTSGESRNNVSSLKNCTSWNMHNKFDCLQSSLDLGPELQDWGSTHESPVDESFPLPLPDGDSFWECKSPVQSSQLWPQNLQDLGAYAELERFDNSNMPDVDLTFQNFEELFGEDQYLNNTLLEEDMTCSSMENDSSIDRSDYSYVKKDISTASSVRTGHSTHFGQAHGEHIPTIKDCPPPIRTNFSSLSFSASRLSSESSGNEYVDSPAANDQEVSCNSQMDSKKKARLYEKQARNTPRRARTNFKKQHVLKAHCYETDALNMSRSF

SEQ ID NO: 421 - DNA, 2385 bp, Brachypodium distachyon
  Bradi2g57087.1
atggcatttggccgaggtgcaaagatggacgggaggcggccttcgtcgccatcctcgtcgttgtgcacgacgaccaccgtcgtcgtttttgtggcgctctgcctggtcggtgcctggatgatgacatcgtccaccgtcttcccactagagaaaccagaggtaagggatcagcgtgcagctgttgattttggcgcaaccgaggagtcaccatctggcaatgctggtggaagttcggcgaaattcgaggataccgacaataatgataatgttccagatgagtcgcacaataacagggatgctcctgaggaagagaagttcactgaggacacaatggagaagcctgtggagaggactgaggaaaaggaagcaccaaaagaaaaagatgaggttaaggattcatttgatgatgcaaatggaaaatcagaggtaaagaattcgaaggagggtggggaaactgggcgttctggtgacgaggaggggaaagacaatgagaccacaactgaaaatgatgttgatcaattcaatggagagaagaaggaagatcaagaaggaaagtctggtgatgatgccatgcaagatgcaactgaacagcctcaaatagaagagaaagttgaagaaagtggagagaaggaacaggctgcgaaggctaacgaggtgtttcctgatgcggctcaatctgaacttctgaaggagtcgaatactgagaatgggtcattctctacgcaggcagcagagtcaaagaaggagaaggaagcccaagcatcatcaaaatcttcaggtgatggaatcacatatagctggaaactatgtaatagcagtgccgtgacagattacataccttgccttgacaatgagaaggctattaagaagcttcattctacaaaacattatgaacatcgtgagaggcattgccctgacgagcctccgacttgccttgttccacttccagaaggatataagcggcccatcgagtggcccaagagcagggacaaggtatggtacagcaacgtccctcacaccaagcttgcagagtacaagggccatcaaaactgggttaaagtttctggggatcatctcttgtttcctgggggcgggacacagttcaagaatggcgcactccactacatcgatactattcagcaggcattacctgatattgcatggggtaaacgaagccgtgtcattctagatgttggttgtggggttgccagctttggaggctacatgtttgatagagatgtgctcacaatgtcatttgctccaaaagatgagcatgaagctcaagtacagtttgcgttggagagaggaattccagcaatatcagctgtaatgggcaccaagagacttccatatcccagcagggtttttgatgtcattcattgtgctcgctgcagagtcccttggcacattgaaggtggcaagcttttgctggaattgaaccgactactacgccctggtggttactttgtgtggtccgccactcctgtttaccaaaagctccctgaagatgttgagatatggaacgccatgtcttctctgacaaaatccatgtgctggaaaatggttaagaaaacaaaggatacactaaatcaagttggtatggccatatatcagaagccaatggacaacaattgctatgagaaaagatcagaagacagccctccattatgcaaggaaactgatgatgcagatgcttcatggaatattacattacaagcatgcatacataaattgcctgttggtccatcagtgagggggtcaaaatggccagagttttggcctcaaaggcttgagaagacccccttctggatcgatggctctcatgttggagtttatggaaaaccagcaaatgaagactttgaggcagattatgcacactggaagcgtgttgtaagtaaatcttacgtgaatggcatgggaatcgactggtctaaagtgagaaatgtcatggacatgagagctgtatatggcggttttgctgcagctctgaggggccagcgacaagtctgggttatgaatattgtgccaattgattctcctgacacactgcccataatttatgagcgtggcttgtttggaatgtatcatgattggtgtgaatctttcagcacttacccaagaacatatgacctactgcatgcagatcatctgttttcaaagctgaaaaagagatgcaaattgttgggagtctttgccgaggttgaccggatattgaggccagaaggcaaattgattgtgagggatagcgcagagacaataatcgaactcgaaggcatggcaaagtccctacactgggaggtaaccatgacctacgccaagggcaacgagggtttgctgtgcgtccagaaaaccatgtggcggcccaaggagatcgaagcaagcatg

SEQ ID NO: 422 - protein, 795 aa, Brachypodium distachyon
  Bradi2g57087.1
MAFGRGAKMDGRRPSSPSSSLCTTTTVVVFVALCLVGAWMMTSSTVFPLEKPEVRDQRAAVDFGATEESPSGNAGGSSAKFEDTDNNDNVPDESHNNRDAPEEEKFTEDTMEKPVERTEEKEAPKEKDEVKDSFDDANGKSEVKNSKEGGETGRSGDEEGKDNETTTENDVDQFNGEKKEDQEGKSGDDAMQDATEQPQIEEKVEESGEKEQAAKANEVFPDAAQSELLKESNTENGSFSTQAAESKKEKEAQASSKSSGDGITYSWKLCNSSAVTDYIPCLDNEKAIKKLHSTKHYEHRERHCPDEPPTCLVPLPEGYKRPIEWPKSRDKVWYSNVPHTKLAEYKGHQNWVKVSGDHLLFPGGGTQFKNGALHYIDTIQQALPDIAWGKRSRVILDVGCGVASFGGYMFDRDVLTMSFAPKDEHEAQVQFALERGIPAISAVMGTKRLPYPSRVFDVIHCARCRVPWHIEGGKLLLELNRLLRPGGYFVWSATPVYQKLPEDVEIWNAMSSLTKSMCWKMVKKTKDTLNQVGMAIYQKPMDNNCYEKRSEDSPPLCKETDDADASWNITLQACIHKLPVGPSVRGSKWPEFWPQRLEKTPFWIDGSHVGVYGKPANEDFEADYAHWKRVVSKSYVNGMGIDWSKVRNVMDMRAVYGGFAAALRGQRQVWVMNIVPIDSPDTLPIIYERGLFGMYHDWCESFSTYPRTYDLLHADHLFSKLKKRCKLLGVFAEVDRILRPEGKLIVRDSAETIIELEGMAKSLHWEVTMTYAKGNEGLLCVQKTMWRPKEIEASM

SEQ ID NO: 423 - DNA, 2418 bp, Oryza sativa
  LOC_Os01g66110.1
atggcatttggccgaggctcgaagatggacggcaggcggtcgtcgccgtcgtcgtcgctctgcacgacgaccaccgtcgtcgtgttcgtggcgctctgcctggtcggcgcctggatgatgacgtcatccaccatcttcccgctggagataacctcgaataagaaggcggcggtgaaggagcagccggcgagagttaactacggcgcgtccgaggaggcagcggcggcatccggcaacagtgctgaaggtgtggacaggtttggggacacggacaacaacgataatgcggttccggaggagccgaataacacggtcccttctgaagaagagaagttcagtgagaacacagtggagaagccagtggagagcagtgaagagaaggcgccaccgaaagaaaaggaggagagtaaggatacatttgatgatgcaaatgggaaaacagaacagtcgagcgccaaggaggatggggattctgaatcaggatctgggcagtcggatggttcaaagaatggcgacgacgaggagaagagtgaggagaagaaagatgatgagcaatctgatggtgagaggaaagatgatcaagaagagaaggctgaaggcagtggctcaaaggacacgactgaccagccacaaattgaggagacagtggatgaaagtggggagaagggtcagggtgcaaagtccaatgaggtattccctgatggggctcaatcagagcttctaaaggagtcaaacaccgagaacgggtcatttaaaacacaggatgcagagtcaaagaatgagaaggaatctcaagcagcatcaaattcttcagatgatgaaaccacatataactggaagttatgcaataacaatgctggaacagattacataccttgcctcgacaatgagaaggctatcaagaagcttcgaaccaccaaacattatgagcaccgtgagaggcattgccctgtggagcctcctacctgtgttgttccacttcctgaaggatataaacgcccagttgagtggcccacgagcagggacaaggtgtggtacagcaatgtcccccacactaagcttgctgagtacaaggggcaccaaaactgggttaaagtttctggggatcatctcctatttcccgggggtggcactcagttcaagaatggtgcacttcactacattgatactattcagcaggcattacctgatattgcatggggcaaacgaagccgtgtcattctagatgttggctgtggagttgctagctttggagggtacatgtttgagagagatgtactcacgatgtcatttgccccaaaagacgagcatgaagctcaagtacagtttgcacttgagagaggtattccagcaatatcagctgtcatgggcaccaaaaggctcccataccccagcagggtctttgatgtcattcattgcgctcgctgcagggtcccttggcacattgaaggtggcatgctattgctggaactgaaccgcctattacgccctggtggttacttcgtctggtctgccactcctgtttaccagaagctccctgaagatgtcgagatttggaatgccatgtcttctctaacaaaggccatgtgctggaaaatggttaacaagactaaggataagttaaatcaagttggtatggccatatatcagaagccaatggacaacagttgctatgagaaaagaccagaaaacagcccaccgttatgcaaggaaactgatgatgctgatgctgcatggaatgtacctttgcaagcatgtatgcacaaattgcctgctggccaatcagtccgagggtcaaaatggccagagacatggccacaaaggcttgagaagaccccctactggatagatgactctcatgttggaatctatggaaaaccaggaaacgaagattttgaggctgattatgctcattggaaacgagtcgtaagtaaatcttatgtgaatggcatgggaatcgactggtctaaagtaagaaacgtcatggacatgagagctgtatatggaggtttcgctgcagctttgagggaccaaaaagtctgggttatgaatattgtgccaacggattcagcagacacgctgcccattatttatgagcgtggcttgtttggtatgtaccatgactggtgtgaatctttcagcacttacccgagaacatacgaccttctgcatgcagaccatctcttctcaaagctaaaaaagagatgcaaattgttgccggtgtttgcggaggtcgacagaatattgaggccagaaggaaagctgattgtgagggataatgcagagacaataaacgaactgcaaggcatggtaaagtcgcttcagtgggaggttcgcatgacctacaccaagggtaacgagggtcttctatgtgtccaaaagtccatgtggcggcccaaggagatcgaggcaagcatg

SEQ ID NO: 424 - protein, 806 aa, Oryza sativa
  LOC_Os01g66110.1
MAFGRGSKMDGRRSSPSSSLCTTTTVVVFVALCLVGAWMMTSSTIFPLEITSNKKAAVKEQPARVNYGASEEAAAASGNSAEGVDRFGDTDNNDNAVPEEPNNTVPSEEEKFSENTVEKPVESSEEKAPPKEKEESKDTFDDANGKTEQSSAKEDGDSESGSGQSDGSKNGDDEEKSEEKKDDEQSDGERKDDQEEKAEGSGSKDTTDQPQIEETVDESGEKGQGAKSNEVFPDGAQSELLKESNTENGSFKTQDAESKNEKESQAASNSSDDETTYNWKLCNNNAGTDYIPCLDNEKAIKKLRTTKHYEHRERHCPVEPPTCVVPLPEGYKRPVEWPTSRDKVWYSNVPHTKLAEYKGHQNWVKVSGDHLLFPGGGTQFKNGALHYIDTIQQALPDIAWGKRSRVILDVGCGVASFGGYMFERDVLTMSFAPKDEHEAQVQFALERGIPAISAVMGTKRLPYPSRVFDVIHCARCRVPWHIEGGMLLLELNRLLRPGGYFVWSATPVYQKLPEDVEIWNAMSSLTKAMCWKMVNKTKDKLNQVGMAIYQKPMDNSCYEKRPENSPPLCKETDDADAAWNVPLQACMHKLPAGQSVRGSKWPETWPQRLEKTPYWIDDSHVGIYGKPGNEDFEADYAHWKRVVSKSYVNGMGIDWSKVRNVMDMRAVYGGFAAALRDQKVWVMNIVPTDSADTLPIIYERGLFGMYHDWCESFSTYPRTYDLLHADHLFSKLKKRCKLLPVFAEVDRILRPEGKLIVRDNAETINELQGMVKSLQWEVRMTYTKGNEGLLCVQKSMWRPKEIEASM

SEQ ID NO: 425 - DNA, 2376 bp, Zea mays
  GRMZM2G049269_T01
atggcatttggccgaggtggaaagatggacggccgccggccgtcctcatcgtcgtcgtcgtcgtcgttctgcacaaccaccacggtcgtgctctttgtggcgctctgcctagtcggcgcgtggatgatgacctcgtccactgtcttcccgctggagatttcgtccaataagaagccggtggtgaagcaacagcctgcgcctgtcaatttcggggcgtcgcaggaggcatcacctggcattgctggtgaagggtccgagaaatttgaggacaccgacaacaatgatgccacagtcccagaggaaccgaataaacaggatgcttctgagcaagagaatttcaatgagaagcctgaagagaaagagctggaagtgccggtagagaaagcggagaccaaggatatgtttgatgacgcaaatggaaaatcagaagggctgtcagatgaaacgaagaatgatgatggggagaagagtgtggagaagaaagacaatgaaatcacaaatgagagtggtgatgaaaaaactgatggtgagagtaaggacggtcaagaagagaagcctgatggcgatgccgctcaggaggagcaacctaaaatagaagagaacgtggaagaaaatggagagaaggatcagagctcaaactccaacgaggtatttcctgatggggcccaatcagagcttctgaaggagtcaaatacccagaacggttcattccccacacaggctgcagagtcaaagaatgaaaaggaagtccaagcgttaccgaagtcttcaggcgatgcaaccagctatacctggaaattatgtaatagtagtgcctcaacagattacataccttgccttgacaacgagaaggctatcaagaagcttcgaactaccaaacattatgaacatcgtgagaggcattgccctgaggagcctcctacctgccttgttccactcccagaaggatataaacggccaattgagtggccaaagagcagggacaaggtatggtacagcaatgttcctcacactaggcttgcagagtacaaggggcatcaaaattgggttaaggtctcaggtgactatctcttgttccctgggggtgggactcagttcaagaatggtgccctccactatattgatactattcagcaggcactacctgatattgcatggggcaaacgaagccgtgtcatattggatgttggttgtggagttgccagctttggaggctacatgtttgatagagatgcgcttaccatgtcttttgctccaaaagatgagcatgaagctcaagtacaatttgcattagaaaggggaattccagcaatatcagctgtgatgggcaccaagagacttccgtaccccagcagagtctttgatgtcattcattgcgctcgctgcagggtcccttggcacatcgaaggtggcatgcttttgctggaattgaaccgcttgttacgccctggtggttactttgtctggtctgccactcctgtttaccaaaagctcccagaggatgttgagatttggaatgccatgtctactttgacaaagtccatgtgctggaagatggtcaacaagactaaggataagttaaaccaagttggtatggtcatatatcagaaaccaatggacaatatttgctatgagaaaagatctgaaaacagcccgccattgtgcaaggaatctgatgatgcagatgctgcttggaatgtaccgttggaagcatgcatgcacaaactgcctggtggctcaaaagtccgaggatcaaaatggccagagttatggccgcaaaggcttgagaagacccctttctggattgatggttccaaggttggtgtctatggaaagcctgcaaatgaagattttgaggcagataatgcccactggaaacgggttgtaagtaaatcgtatgtgaatggcatgggaattgactggtccaaagtgagaaatgtcatggacatgagagctgtctatggaggttttgctgcagctctgagggaccaaaaggtctgggtcatgaatatcgtgccgatcgattcaccagacacgctgcccatcatctacgagcgcggtttgtttggcatgtaccatgactggtgcgagtctttcagcacttacccaagaacgtatgaccttctgcacgcggaccatctgttctcaaagctcagaaagagatgcaaactggctgcagttttcgccgaggtcgaccgtgtactgaggccacagggcaagctgatcgtgagggacaccgcggacacgataaatgagctggagagcatggccaagtccgtgcagtgggaggtgcggatgacctacaccaagggcagcgagggcctgctctgcgtcgagaagtcgatgtggcggcccaaagaactcgacgctagcacg

SEQ ID NO: 426 - protein, 792 aa, Zea mays
  GRMZM2G049269_T01
MAFGRGGKMDGRRPSSSSSSSSFCTTTTVVLFVALCLVGAWMMTSSTVFPLEISSNKKPVVKQQPAPVNFGASQEASPGIAGEGSEKFEDTDNNDATVPEEPNKQDASEQENFNEKPEEKELEVPVEKAETKDMFDDANGKSEGLSDETKNDDGEKSVEKKDNEITNESGDEKTDGESKDGQEEKPDGDAAQEEQPKIEENVEENGEKDQSSNSNEVFPDGAQSELLKESNTQNGSFPTQAAESKNEKEVQALPKSSGDATSYTWKLCNSSASTDYIPCLDNEKAIKKLRTTKHYEHRERHCPEEPPTCLVPLPEGYKRPIEWPKSRDKVWYSNVPHTRLAEYKGHQNWVKVSGDYLLFPGGGTQFKNGALHYIDTIQQALPDIAWGKRSRVILDVGCGVASFGGYMFDRDALTMSFAPKDEHEAQVQFALERGIPAISAVMGTKRLPYPSRVFDVIHCARCRVPWHIEGGMLLLELNRLLRPGGYFVWSATPVYQKLPEDVEIWNAMSTLTKSMCWKMVNKTKDKLNQVGMVIYQKPMDNICYEKRSENSPPLCKESDDADAAWNVPLEACMHKLPGGSKVRGSKWPELWPQRLEKTPFWIDGSKVGVYGKPANEDFEADNAHWKRVVSKSYVNGMGIDWSKVRNVMDMRAVYGGFAAALRDQKVWVMNIVPIDSPDTLPIIYERGLFGMYHDWCESFSTYPRTYDLLHADHLFSKLRKRCKLAAVFAEVDRVLRPQGKLIVRDTADTINELESMAKSVQWEVRMTYTKGSEGLLCVEKSMWRPKELDAST

SEQ ID NO: 427 - DNA, 2391 bp, Setaria italica
  Si000354m
atggcatttggccggggtgcaaagatggacggccgccggccgtcctcgtcgtcctcgtcgttctgcacgaccaccacggtcgtcgtctttgtggcgctctgcctggttggcgcgtggatgatgacgtcgtccaccgtcttcccgctggagatttcgtcgaataagaagtctgtggtgaagcaacagccagcgcctgttaacttcggtgcgtctgaggatgcagcatctggcaatgctggtgaaagttctgggaaatttgaagataccgacaacaacgacaccactgtcccagaagagtcgaataacaaggaagctcctgaggaagagaagttcaccgagaacatggcggagaagcctgaagagaaggagcaggaaccaccaagagagagagaggagaacaaggatatgtttgacgatgcaaatggaaaatcagaagggcggtcagatgatgtgaagaatgacaatgatgatggagataagagcgaggaaaagaaagatgatgaaatcacaaatgagagtggtgatgagaaacctgacggtgagaggaaggatgatcgagaagaaaagtctgaaggtgatgccactcaggaggagcaacctcaaatagaagagaaggtggaagaaagtggagagaagaaggaacagagctcaaactctaatgaggtatttcctgatggggctgaatcagagcttctaaaggagtcaaatacccagaatggttcgttccccacacaggctgcagagtcaaagaatgagaaggaagttcgagcatcatcaaaatcatcaggtgatgagtccagctatagctggaaactatgcaatagcagtgcctcgacagattatattccttgccttgacaatgagaaggctatcaagaagcttcgaagtaccaaacattatgaacatcgtgaaagacattgccctgaggagcccccgacctgccttgttccactcccagaaggatataaacgcccaattgaatggccaaagagcagggacaaggtatggtacagcaatgttccacacaccaggcttgcggagtacaagggtcaccaaaactgggttaaagtctctggtgactacctcctgtttcctgggggagggactcagttcaagaatggtgcacttcactacattgatactattcagcaggcgctgcctaatattgcatggggcaaacgaagccgtgtcattctagatgttggttgtggtgttgccagttttggaggttacatgtttgacagagatgtgcttaccatgtcttttgctccaaaagatgagcatgaagctcaagtacaatttgcactagaaaggggaattccagcaatatcagctgtgatgggcacaaagagacttccataccccagcagggtctttgatgtcattcattgtgctcgctgcagggtcccttggcacatcgaaggtggcatgcttttgctagaacttaaccgccttctacgccctggtggttacttcgtctggtctgccactcctgtttaccagaaactcccagaggatgtcgagatttggaatgccatgtcggctctgacaaagtccatgtgctggaagatggtcaacaagactaaggataagttaaaccaggttggtatggcaatatatcagaaaccaatggataacaattgctatgagaaaagatcagaaaacaacccgccattatgcaaggattctgatgatgcagatgctgcttggaatgtacctttggaagcatgcatgcacaagttgcccgctggcccgactgttcgaggagcaaaatggccagagtcatggccacaaaggcttgagaagacccctttctggcttaatggttcccaggttggagtctatggaaaacctgcaaatgaagactttgaggcagacaatgctcactggaaacgggttgtaagtaaatcatatgtgaatggcatgggaattgactggtccaaagtgagaaatgtcatggacatgagagcagtgtatggaggttttgctgcagctctgagggaccaaaaggtctgggttatgaatatcgtgccaattgattcgccagacaccttgcccatcatttatgagcgcggtttgtttggtatgtatcatgactggtgtgagtctttcagcacttacccaagaacatatgaccttctgcacgcagaccatctgttctcgaagctcaaaaagagatgcaaattgatggcagtttttgccgaggtcgaccgtgtgttgaggccacaaggcaaactgattgtgagggacaccgcggacacaataaacgaactggagagcatggccaagtccctgaagtgggaggtgcgcatgacctacaccaagggtaacgaggggttactctgcgtcgagaagtcgatgtggcggcccaaggagcttgaagcaagcacg

SEQ ID NO: 428 - protein, 797 aa, Setaria italica
  Si000354m
MAFGRGAKMDGRRPSSSSSSFCTTTTVVVFVALCLVGAWMMTSSTVFPLEISSNKKSVVKQQPAPVNFGASEDAASGNAGESSGKFEDTDNNDTTVPEESNNKEAPEEEKFTENMAEKPEEKEQEPPREREENKDMFDDANGKSEGRSDDVKNDNDDGDKSEEKKDDEITNESGDEKPDGERKDDREEKSEGDATQEEQPQIEEKVEESGEKKEQSSNSNEVFPDGAESELLKESNTQNGSFPTQAAESKNEKEVRASSKSSGDESSYSWKLCNSSASTDYIPCLDNEKAIKKLRSTKHYEHRERHCPEEPPTCLVPLPEGYKRPIEWPKSRDKVWYSNVPHTRLAEYKGHQNWVKVSGDYLLFPGGGTQFKNGALHYIDTIQQALPNIAWGKRSRVILDVGCGVASFGGYMFDRDVLTMSFAPKDEHEAQVQFALERGIPAISAVMGTKRLPYPSRVFDVIHCARCRVPWHIEGGMLLLELNRLLRPGGYFVWSATPVYQKLPEDVEIWNAMSALTKSMCWKMVNKTKDKLNQVGMAIYQKPMDNNCYEKRSENNPPLCKDSDDADAAWNVPLEACMHKLPAGPTVRGAKWPESWPQRLEKTPFWLNGSQVGVYGKPANEDFEADNAHWKRVVSKSYVNGMGIDWSKVRNVMDMRAVYGGFAAALRDQKVWVMNIVPIDSPDTLPIIYERGLFGMYHDWCESFSTYPRTYDLLHADHLFSKLKKRCKLMAVFAEVDRVLRPQGKLIVRDTADTINELESMAKSLKWEVRMTYTKGNEGLLCVEKSMWRPKELEAST

SEQ ID NO: 429 - DNA, 2148 bp, Brachypodium distachyon
  Bradi5g27590.1
atggcgctgggccacacgcggctcgacgtccggcggctgcagcagcactcctcctcctactgctccgccaccaccgtcgtcgtcttcgtcgcgctctgcttggtcggcgtctggatggcctcttccatgctcgtcacgcccgccgacttctcccccttccagccctcattgccgcgtcgtcccgtcgcaactccagcgaagggcgactcgcggcccgtcgttagagaagaaagcgccgaggagaagcctgaggacgccgtgcctgcggatgaggccacagagaaaacaacaaatcagcctggtgaacaacagagtgtgccagagctcaaggagaagctggatgaggagcaggaggcaaagaagaagggggacaagcctcatgaacagaatgtgttcaagcccgacgtggagcaggaggcgaagaaggaggccgaggtgtttccggatgccagtcaagccgagcttctctacgagacagctacggagccggggccatggcgcacgcaagctgccgagtccaacatggagaccaaggagaaaaccaccgcatcgagtatcccggcgagttttagctggaagctctgcaatgttgaggctggagctgattacattccgtgccttgacaatgtggaagcgatcaagaagcttcggagtgacacgcactacgaacaccgagaaaggcattgccctcaagagcctcctacctgccttgttcctctgccgaagggttacaggagtccaataagatggcctgagagcagagatcagatatggtacaacaatgttcctcatactaagctggtagaatacaagggacaccaaaactgggttaatgtctctggggatcacctaatctttccgggaggcggaactcagttcaagcgtggtgcattgcattatattgatttcattcaggaggcaaagaaagatgtggcatggggaaaacgaactcgtgtagttttagatgttggctgtggagttgctagctttggaggatatctgtttgacagagatgtacttactatgtcttttgcacctaaagatgagcatgaagctcaggtgcagtttgctcttgagagaggaatccctgctatatcagctgttatgggtacaaaaaggctcccatttcctggtagggtctttgatgctgttcattgtgcacgctgtagggtaccatggcatattgaaggtggtaagctcttgctagaattggatagactgttaaggcctggtggttactttgtgtggtctgctactcctgcataccagaaactgccagaagatgttgagatatggcaagcaatgtctgctctaacaaggtcaatgtgctggaaaatggtcaataaagtaaaggataggctaaatcgagttggtgtagcaattttccaaaaaccaatagacaacaggtgctatgatggaagatctgctgcaaaccttccactgtgtggagaatatgataatgttgatgctgcctggaatgtttcattggagtcttgtatacataaattgcctgtagatccggccattcgtagttcacgttggccggaggaatggccattgagattggaaagagcaccttactggctgaagagctctgagcctggagtctatggaaagcctgctcctgaagattttgaagcagattacgatcactggaagcgggtcataagcaattcgtatatggatggcttgggtattgattggtctgctgtcaggaatgtgatggacatgaatgctgtatacggagggtttgcagcagctttgcgagatgtgaaggtgtgggtcatgaatgtagttccaatcgactcgcccgacacactcgcgatcatatacgagcgtgggttgtttggactctaccacgactggtgcgagtcgtttagcacgtacccgagaagctatgatcttgtgcacgcagatcatattttctccaaggttaaaaagaggtgtggactattgagtgtgatagtggaggtggatcggatggcgaggccagaagggaggctgattgttagggatgacatggagacgataaacgaggtgcggtcgatcgccgagtcgctgcactgggaggtccggctgtcatactcccaggagaaggaaggccttctgtttgtgcagaagaccatgtggcgaccaagtccttctagc

SEQ ID NO: 430 - protein, 716 aa, Brachypodium distachyon
  Bradi5g27590.1
MALGHTRLDVRRLQQHSSSYCSATTVVVFVALCLVGVWMASSMLVTPADFSPFQPSLPRRPVATPAKGDSRPVVREESAEEKPEDAVPADEATEKTTNQPGEQQSVPELKEKLDEEQEAKKKGDKPHEQNVFKPDVEQEAKKEAEVFPDASQAELLYETATEPGPWRTQAAESNMETKEKTTASSIPASFSWKLCNVEAGADYIPCLDNVEAIKKLRSDTHYEHRERHCPQEPPTCLVPLPKGYRSPIRWPESRDQIWYNNVPHTKLVEYKGHQNWVNVSGDHLIFPGGGTQFKRGALHYIDFIQEAKKDVAWGKRTRVVLDVGCGVASFGGYLFDRDVLTMSFAPKDEHEAQVQFALERGIPAISAVMGTKRLPFPGRVFDAVHCARCRVPWHIEGGKLLLELDRLLRPGGYFVWSATPAYQKLPEDVEIWQAMSALTRSMCWKMVNKVKDRLNRVGVAIFQKPIDNRCYDGRSAANLPLCGEYDNVDAAWNVSLESCIHKLPVDPAIRSSRWPEEWPLRLERAPYWLKSSEPGVYGKPAPEDFEADYDHWKRVISNSYMDGLGIDWSAVRNVMDMNAVYGGFAAALRDVKVWVMNVVPIDSPDTLAIIYERGLFGLYHDWCESFSTYPRSYDLVHADHIFSKVKKRCGLLSVIVEVDRMARPEGRLIVRDDMETINEVRSIAESLHWEVRLSYSQEKEGLLFVQKTMWRPSPSS

SEQ ID NO: 431 - DNA, 2031 bp, Oryza sativa
  LOC_Os04g59590.1
atggcgtttggcagccacacgcgcctggatgtgaggcgggcgcagcagcactcctcattctgctccccctcctccgccgccgccgtcttggtggcgctggccttggtcgccgtctggatggcctcttccacgctcgtcacccccgcggatttctcccccttccgccccacaaccacaaccacaaccacaaccgctcgacctcggaatcggatggatcctgtgactgttgaagaggacgccgacgaccctcctccactcacactcagacagactgagaccggacccggaggggataatggctcccactcccactccccctccctggagaccgctacagaggcagaccctcaagctgcacagtccaacagcaacaccaaggacactccccacaataagcagcagcagcagcagactgcgtcgcccacccccagcagctatgcttggaagctctgcaatactgaggctggtccagattacatcccatgcctcgacaatctccaagccatccgcaaccttcggacgaccaagcactatgaacaccgagaaaggcattgcccccaacaccctcctacctgccttgtccctcttccaaagggctacacaaatccaattaggtggcctaacagcagagatcagatatggtacaacaatgtcccgcatactaagctggtagaatacaagggtcatcagaactgggttaaggtctccggggagtacctcacctttccgggaggaggaactcagttcaaacatggcgcattgcactacattgatttcattcaggaggcaaagaaggatatagcatgggggaaacaaactcgtgtggttttagatgttggttgcggagttgccagctttggaggatatttatttgatagagatgttcttactatgtcgtttgcacctaaagatgagcatgaagcccaggtgcagtttgctcttgagagaggaatccctgctatgtcagcagttatgggtacaaaaaggcttccattccccggcagggtcttcgacgttgttcattgtgcacgctgtagggtaccatggcatattgaaggtggtaagctcttgctagaactggatagactgttgcgtcctggtggctactttgtgtggtctgccactcctgtgtaccagaagctgccagaagatgttgaaatatgggaagcaatgtctactctaacaaggtcgatgtgttgggaaatggtcaataaagtgaaggatagggtaaatagagtgggtatagcaattttcagaaagccaacggataatagctgttatgaggcaagatcagcagcaaaccctccaatctgtggagagtatgatgatcctgatgctgcctggaacatatcattgcagtcatgcgtgcataggttgcccactgatcctgccatccgtggttcacagtggccggtggaatggccattgaggttggagaaaccaccttactggctgaaaaactctgaggctggtgtctatgggaagcctgccactgaggattttcaagcagactatgagcactggaagcaggtcataagcaattcatatatgaatgacttgggcattgattggtcagctgttagaaatgttatggacatgaaagccgcatatggagggtttgcggcagctttgcgagatctgaagctgtgggttatgaatgttattccaattgattcacctgacacacttccaattatatatgagcgtgggttgtttggaatctaccatgattggtgtgagtcatttagcacctaccccagaacctatgatcttctgcacgcgaaccatcttttctccaagattaaaaagagtgacaggtgtaaactagtggcagtgatggtggaggtggatcgaatactgaggccaggaggcaggctaattgttagagatagtatggagacaatgcatgaagtggagtctatggcaaaatcgctacactgggaggtccgcaagtcttactcccaggacaatgaaggtttgctgtttgttgagaagacgatgtggcgaccaaatgaagttgaagctaagcta

SEQ ID NO: 432 - protein, 677 aa, Oryza sativa
  LOC_Os04g59590.1
MAFGSHTRLDVRRAQQHSSFCSPSSAAAVLVALALVAVWMASSTLVTPADFSPFRPTTTTTTTTARPRNRMDPVTVEEDADDPPPLTLRQTETGPGGDNGSHSHSPSLETATEADPQAAQSNSNTKDTPHNKQQQQQTASPTPSSYAWKLCNTEAGPDYIPCLDNLQAIRNLRTTKHYEHRERHCPQHPPTCLVPLPKGYTNPIRWPNSRDQIWYNNVPHTKLVEYKGHQNWVKVSGEYLTFPGGGTQFKHGALHYIDFIQEAKKDIAWGKQTRVVLDVGCGVASFGGYLFDRDVLTMSFAPKDEHEAQVQFALERGIPAMSAVMGTKRLPFPGRVFDVVHCARCRVPWHIEGGKLLLELDRLLRPGGYFVWSATPVYQKLPEDVEIWEAMSTLTRSMCWEMVNKVKDRVNRVGIAIFRKPTDNSCYEARSAANPPICGEYDDPDAAWNISLQSCVHRLPTDPAIRGSQWPVEWPLRLEKPPYWLKNSEAGVYGKPATEDFQADYEHWKQVISNSYMNDLGIDWSAVRNVMDMKAAYGGFAAALRDLKLWVMNVIPIDSPDTLPIIYERGLFGIYHDWCESFSTYPRTYDLLHANHLFSKIKKSDRCKLVAVMVEVDRILRPGGRLIVRDSMETMHEVESMAKSLHWEVRKSYSQDNEGLLFVEKTMWRPNEVEAKL

SEQ ID NO: 433 - DNA, 2013 bp, Zea mays
  GRMZM2G002642_T02
atgccgttcggccacacgcggctcgatgtccggcgtccgccgcagtcgtcctacctctgctgctccacaaccaccgtcgccgtattcgtcgcgctctgcctggtggctgtgtggatggcgtcgtccatgctcgtcacccctgccgagttccctccatttcagtccaaagtgcgtccactgaggcctcatgactctcctcctgccaccggaagcttaaccagtgctgatcagggcgatggcatcaccacccatgatgatccaccacctgctacacaacaattgcctcctgtaacagacagcatggatggtgaaaatcagcaacaagaacttttcactacagagcgcggaccatggtcaaccaaggctgaacaatctaacaaggacgctaaagagcaaaccttgacgtccagtagcccactgagcttccgttgggcgttatgcaacgtcgatgctggagcagattatattccatgcctcgacaacgtagcagctatcaagaagctccgttccaccaagcactacgaacaccgagaaaggcattgccccgagaaatctcctacctgccttgttcctctaccagagggctacaggaatccaattaggtggccaaagagcagagatcagatatggtacaataacgttcctcatactaagctggttgaatacaagggacaccaaaactgggttaaggtttctggagaatacctcaccttccccggaggcgggactcagtttaaacatggtgcgttgcgctacattgattttattcaggaggcaaagaaggatgtagcatggggaaaacgaagccgtgtagtgttagatgttggttgtggagtagctagctttggaggatatctatttgacagagatgtgattactatgtcatttgcacctaaagatgagcacgaagctcaggttcagtttgctcttgaaagaggaatacctgctatatcagctgtcatgggtacaaaaaggctcccatttcccagtagggtgtttgatgttgttcattgtgcacgatgtagggtaccgtggcatattgaaggcggtaaactcttgcttgaactggacagactgttacgtcctggtggttactttgtgtggtctgctacacccgtataccagaagctgcctgaagatgttgagatatggcaagccatgtctgctctaaccagttcaatgtgctggaaaatggtcaacaaagtaaaggatagggtgaatagagtgggtatagcaatttacagaaagccaacagacaacagctgctacgaagcaagatctgaaacaaaccctccactctgtggagagtacgacgatcctgatgctgcctggaacatatcgttgggggcttgtatgcataagttgcctgtagatcctaccgttcgtggttcacagtggcctgagttatggccattgagactggagaaaccaccttattggctgagaggttctgaggctggagtatatgggaaacctgccccggaggattttcaagcagactatgaacactggaagcgagtcgtgagcaattcatacatgaatggtttgggtattgactggtctactgttagaaatgttatggatatgaaagccgtatatgcagggttcgcagcagctttgcgcgatctcaaggtgtgggtcatgaatgtggttccaattgattcacctgacacgcttccaattatatatgagcgcgggctgtttggactgtaccatgactggtgtgagtcgtttagcacctatccgagaacttatgatcttgtgcacgccaaccatctgttctccaaggttaagaagaggtgcgagctattacctgttatcgtggaggtggaccgggtgttgaggccacaaggccggctaattgtcagagacaacattgaaacaacaagtgaggtggagaacattctgaaatctctccactgggaggtccgcatgtcttacttccaggagaaagaaggcttgctgttggtgcagaagacgacatggcggccaaatgaaactgaagctaagcta

SEQ ID NO: 434 - protein, 671 aa, Zea mays
  GRMZM2G002642_T02
MPFGHTRLDVRRPPQSSYLCCSTTTVAVFVALCLVAVWMASSMLVTPAEFPPFQSKVRPLRPHDSPPATGSLTSADQGDGITTHDDPPPATQQLPPVTDSMDGENQQQELFTTERGPWSTKAEQSNKDAKEQTLTSSSPLSFRWALCNVDAGADYIPCLDNVAAIKKLRSTKHYEHRERHCPEKSPTCLVPLPEGYRNPIRWPKSRDQIWYNNVPHTKLVEYKGHQNWVKVSGEYLTFPGGGTQFKHGALRYIDFIQEAKKDVAWGKRSRVVLDVGCGVASFGGYLFDRDVITMSFAPKDEHEAQVQFALERGIPAISAVMGTKRLPFPSRVFDVVHCARCRVPWHIEGGKLLLELDRLLRPGGYFVWSATPVYQKLPEDVEIWQAMSALTSSMCWKMVNKVKDRVNRVGIAIYRKPTDNSCYEARSETNPPLCGEYDDPDAAWNISLGACMHKLPVDPTVRGSQWPELWPLRLEKPPYWLRGSEAGVYGKPAPEDFQADYEHWKRVVSNSYMNGLGIDWSTVRNVMDMKAVYAGFAAALRDLKVWVMNVVPIDSPDTLPIIYERGLFGLYHDWCESFSTYPRTYDLVHANHLFSKVKKRCELLPVIVEVDRVLRPQGRLIVRDNIETTSEVENILKSLHWEVRMSYFQEKEGLLLVQKTTWRPNETEAKL

SEQ ID NO: 435 - DNA, 2211 bp, Setaria italica
  Si021320m
atggcgttcggccacacgcggctcgatgcccggcggccaccgcagtcctcctactgctcctgctccaccgccaccatcgtcgtcgcgctctgcttggtcgctgtgtggatggcatcaaccatgctcgtcacccccgccgagttccctccttttcagcccaaagtccgcccattggcacctcatgactctcctcctgccaccggaggcttaaccaatgccggtgaggatgatgccaccggtgaaatggaacgggatgtgccccttgatccagtgccggccgagggaaccacaaccaccgatgatgatccaccacctgttacagagcaagtgcctcctgtaacaaaggacgctgccacagagtccagcaccgatggtccgcagcagaatgtcagggagcaagtcaagcagcctgatgaacagagtgcctcaaagctcaaggagaagttgaatgagaataagcaggcaccaaaggaagataagccaacagaggtgttccctgatgggagtcaagcagagcttctgaatgagaccaccacggagcgcggaccatggcctactcaggctgcacaatctaacaaggacactaaggagcaaacagcgacgtcgagtaccccaatgagctttagttggaagctgtgcaatgttgacgccagagcagattatattccatgcctcgacaacgtacaagctatcaacaagcttcgttccaccaagcactatgaacatcgagaaaggcattgccctgagaagcctcctacctgccttgttcctctaccagagggctatagtaatccaataaggtggcctaagagcagggatcagatatggtacaataacgtccctcatactaagctgatcgaatacaagggacaccaaaactgggttaaggtttctggggagcacctcatttttccgggaggtggaactcagttcaaacatggtgcattgcattacattgatttcattcaggaggcaaagaaggacatagcatggggaaaacgtactcgtgtagttttagatgttggttgtggagtagctagctttggaggatatctatttgacagagatgtgatcactatgtcatttgcacctaaagatgagcatgaagctcaggtgcaatttgctcttgaaagaggaatccctgctatatcagctgtcatgggtacaaaaaggctcccatttcccagtagggtctttgatgttgttcattgtgcacgctgtagggtaccatggcatattgaagggggtaaactcttgctcgaattggacagactgttgcgtcctggtggttacttcgtgtggtctgctactcctgtataccagaagttgcctgaagatgttgagatatgggaagcaatgtctgctctaactaggtcaatgtgctggaaaatggtcaacaaagtaaaggatagagtgaatagagtgggtatagcaattttcagaaagccaacagataacagctgctatgaagaaagatctgaagcaaactctccaatctgtggagagtatgatgatcctgatgcagcgtggaacgtatcattgaggacttgtatgcataagttgcctgtagatcttaccattcgtggttcaaaatggccggagttatggccattgagactggagaaaccaccttattggctgaaaagttctgaggctggagtatacgggaaacctgccccagaagattttcaagtggactatgaacattggaagcgagtcgtgagcaattcatacatgaatggtttgggtgttgattggtcggctgttagaaatgttatggatatgaaagctgtatatggagggtttgcggcagctttgcatgatctcaaggtgtgggtcatgaatgtgatcccaattgattcacctgacacacttccaattatatatgagcgtgggctgtttggactgtatcatgactggtgtgagtcgtttagcacctatccaagaacttatgatcttctgcatgctaaccatctgttctccaaggttaagaagaggtgtgaattattacctgttgttgtggaggtggatcgggtgttgaggccagaaggccggctaattgtaagagacaacattgaaacaataagtgaggtggagaatattgtgaaatcactccactgggaggtccggatgtcttattcccaggataaagaaggcttgctgtttgtgcaaaagacgtcatggcgaccaaatgaagttgaagctaagcta

SEQ ID NO: 436 - protein, 737 aa, Setaria italica
  Si021320m
MAFGHTRLDARRPPQSSYCSCSTATIVVALCLVAVWMASTMLVTPAEFPPFQPKVRPLAPHDSPPATGGLTNAGEDDATGEMERDVPLDPVPAEGTTTTDDDPPPVTEQVPPVTKDAATESSTDGPQQNVREQVKQPDEQSASKLKEKLNENKQAPKEDKPTEVFPDGSQAELLNETTTERGPWPTQAAQSNKDTKEQTATSSTPMSFSWKLCNVDARADYIPCLDNVQAINKLRSTKHYEHRERHCPEKPPTCLVPLPEGYSNPIRWPKSRDQIWYNNVPHTKLIEYKGHQNWVKVSGEHLIFPGGGTQFKHGALHYIDFIQEAKKDIAWGKRTRVVLDVGCGVASFGGYLFDRDVITMSFAPKDEHEAQVQFALERGIPAISAVMGTKRLPFPSRVFDVVHCARCRVPWHIEGGKLLLELDRLLRPGGYFVWSATPVYQKLPEDVEIWEAMSALTRSMCWKMVNKVKDRVNRVGIAIFRKPTDNSCYEERSEANSPICGEYDDPDAAWNVSLRTCMHKLPVDLTIRGSKWPELWPLRLEKPPYWLKSSEAGVYGKPAPEDFQVDYEHWKRVVSNSYMNGLGVDWSAVRNVMDMKAVYGGFAAALHDLKVWVMNVIPIDSPDTLPIIYERGLFGLYHDWCESFSTYPRTYDLLHANHLFSKVKKRCELLPVVVEVDRVLRPEGRLIVRDNIETISEVENIVKSLHWEVRMSYSQDKEGLLFVQKTSWRPNEVEAKL

SEQ ID NO: 437 - DNA, 2610 bp, Brachypodium distachyon
  Bradi4g23610.1
atggcactgttcgatcggaaccagagggggcagcggtcgtcgctgttctcgacggccaccatcgtcctctttgtggcgctctgcctcgtcggcttctggatggtctccacgccgtcggcgccaccggaagccctcccgacgacgacgacagcctcggcggcagccgaggtcgtcaagaaggcagacgccgccggcgccgccaaggagaaggaggaggacagctccattgacgccaccaacaacttcaagcaggacagcaccaacgtcgttgccgccgaggtcgtcgccaccaatgccgagaccaacaaccccgacaatggcggcggcggcgacggagacaaggcggcgtcgttcgacgacgagaacggccggacggagggcggcgagctcgtcaagccggagaccaccgccgacgcggacagtgccgctgccgccgcagctgtcgctgccaggaagaccgtcgatgacaccacaaccgcgaaggacggcgagaagacgtcgggcgacacgaagaactctgacgagagtacggtgtcggcggcgtcgaagaagcagacgttcgacgacgagaacgggaagatggaaggcgtggatgtggtgaaggacgacgccggcgctaacaacagcaacaagacgttcatctcggaagacatcaccgtcaagccaatcgccgacgagtcgtctacggcagcagaagccaagctgacgtcgtcggacagcaccggcgagcagcaagcacttcaagaagaagatcagatgaacctcctcccagaggccctccctaacgggcaggcagagcttctcaccgagcgcgcagcccagaacgggtccttcacgacacaagcggacgaatccaccaacgagaagaacaagcgcgccgccgagctgaagaacagcaccacaaagaagacaaagaagaagaaggccaagaagcccaagggcgccaacaacaacaaaaacaatggcacatcctccttgtcttcttcttcctcgacgacgacggtctcatggccctacgcatggaagctctgcaacacgagcgcgggggccgactacatcccgtgcctggacaacgaggcggccatcagcaagctcaagacgaacaagcggtacgagcaccgggagcggcactgcccctcgaccccgccgacgtgcctcgtgccctccccggcggcgtaccgcgagccgatccggtggcccgcgagccggtccaagatctggtaccacaacgtgccgcacgcaagcctggctagctacaagcataaccagaactgggtgaagctgtccggggagcacctggtcttccccggcggcggcactcagttcaagacaggaggagcgttgcactacattgatctcatccaggaggcgctcccggaggtggcctgggggcggcggagccgggtggtgctcgacgttggctgcggggtggctagcttcggcgggttcctcttcgaccggggtgcgctcaccatgtccttcgcgcccaaggacgagcacgaggcccaggtgcagttcgcgctggagagggggatcccggccttgtccgccgtgatgggcacgaagcggctgccgttcccggcgggggtgttcgatgtggtgcactgcgcgcggtgccgcgtgccgtggcacatcgacggcggcatgctgctgctggagctcaaccggctgcttcggcccggtggcttctttgtgtggtccgccacgccggtgtaccagaagcttcctgaagacgtcgagatctgggatgacatggtgaagctgaccaaggccatgtgttgggagatggtgaagaagacagaggacacgctggaccaggtggggctggtcatcttccggaagcccaagagcaaccggtgctacgagacacggcggcagaaggagccgccgctatgcgacggctccgatgacccgaacgcggcttggaacatcaagctacgggcgtgcatgcaccgggcgccggcagactacccatcggtgcgcgggtcccggtggccggcgccgtggccggagagggcggaggcggtgccctactggttaaacaacagccaggtcggggtctacggcaggccggcacgggaggactttgcggcggactacgagcattggaggaaggtggtccagaactcgtacctcaccggcatgggcattgactgggcggccgtccgcaacgtgatggacatgagagccgtctacggtggcctcgcggcggcgctgagggacatgagcgtgtgggtgatgaacaccgtcaccattgactcgccggacaccctgccggtgatcttcgagcgcggactcttcgggatctaccacgactggtgtgagtccttcagcacctacccgcggtcctacgacctcctccatgccgaccatctcttctccaagctcaagacccggtgtaaggtgttgccggtgatcgtggaggcggacaggatcttgaggccgaacgggaagctgatcgtgagggacgacaaggagacggtgaacgagatcgttgagctggtgaggtcgatgcattgggaggtcaggatgaccgtctccaaccgcaaagaagccatgctctgcgcaaggaagaccatgtggcggccaacggaggtcgaggccagaaga

SEQ ID NO: 438 - protein, 870 aa, Brachypodium distachyon
  Bradi4g23610.1
MALFDRNQRGQRSSLFSTATIVLFVALCLVGFWMVSTPSAPPEALPTTTTASAAAEVVKKADAAGAAKEKEEDSSIDATNNFKQDSTNVVAAEVVATNAETNNPDNGGGGDGDKAASFDDENGRTEGGELVKPETTADADSAAAAAAVAARKTVDDTTTAKDGEKTSGDTKNSDESTVSAASKKQTFDDENGKMEGVDVVKDDAGANNSNKTFISEDITVKPIADESSTAAEAKLTSSDSTGEQQALQEEDQMNLLPEALPNGQAELLTERAAQNGSFTTQADESTNEKNKRAAELKNSTTKKTKKKKAKKPKGANNNKNNGTSSLSSSSSTTTVSWPYAWKLCNTSAGADYIPCLDNEAAISKLKTNKRYEHRERHCPSTPPTCLVPSPAAYREPIRWPASRSKIWYHNVPHASLASYKHNQNWVKLSGEHLVFPGGGTQFKTGGALHYIDLIQEALPEVAWGRRSRVVLDVGCGVASFGGFLFDRGALTMSFAPKDEHEAQVQFALERGIPALSAVMGTKRLPFPAGVFDVVHCARCRVPWHIDGGMLLLELNRLLRPGGFFVWSATPVYQKLPEDVEIWDDMVKLTKAMCWEMVKKTEDTLDQVGLVIFRKPKSNRCYETRRQKEPPLCDGSDDPNAAWNIKLRACMHRAPADYPSVRGSRWPAPWPERAEAVPYWLNNSQVGVYGRPAREDFAADYEHWRKVVQNSYLTGMGIDWAAVRNVMDMRAVYGGLAAALRDMSVWVMNTVTIDSPDTLPVIFERGLFGIYHDWCESFSTYPRSYDLLHADHLFSKLKTRCKVLPVIVEADRILRPNGKLIVRDDKETVNEIVELVRSMHWEVRMTVSNRKEAMLCARKTMWRPTEVEARR

SEQ ID NO: 439 - DNA, 2601 bp, Oryza sativa
  LOC_Os11g08314.1
atggcgctgtttgatcggaatcagaagcagcggtcgtcgctgtgctcgacggcgaccgtcgtcgtgttcgtggcgctctgcctcgtcggcctctggatgatctcctcgccggagaccatcccggcggcggcggccaacgtcagcaagaagcccgacgtcgtcgccgtcaaggaggaggacagctcgctcgacgccaccaacaatgtcaaacagaacagcgccaacgtcgtcgccgagaccgccgccgccgacgaggccgccgccgcagacgaggacgacaaccccgcgaagccggccgccggcgagaaggcggcggcggcggcggcgtcgtccaaggaccagacgttcgacgacgagaacggcaggacggagggcggcgcgctcgtcaagccggagagcggcggcggcgacgaggcggcctccgacgtgaaggagatcggcagcctcgagcaggcggcgatcgacatgaaggacaccaccgagcactcggtgggtgacaccaccaaggagccaggcgtcgtccaggacaagagctccgaggagatcacgatggcggcgagcgacgcgagggagagcagcgatggcggcggcggcggcggcgcggccaagaacaagcagacgttcgacgacgagaacggcaagctcgacggcgtcaacctggtgaaggacgtcgagaacaagacgatgtcggaggagggcgccaagccattgccggaggagacgacgaccgtgagcagcaagaactcgatcgtcgcggcggccgccatgtccgacgagaagctcaccgacaacaatggcgagcaagcgcagccggtggaggcgctgccgaacgggcaggccgagctgctgacggagcgcgcggcgcagaatgggtcgttcacgacgcaggcggcggagtcgatcaaggagaagaagaagcgcgccgagaagaagaaaaagaagaagaagaaggtgaaggcggcgtcggtggcggcggcggcggaggaggagggcggcggcggcggcgcggcgtcgttgggctggaggctctgcaacacgagcgccggcgccgactacatcccgtgcctggacaacgaggccgccatcaagaagctcaagacgaccgcgcactacgagcaccgcgagcgccactgccccgcctcgccgccgacgtgcctcgtcccgtcgccggaggggtaccgggacccgatccggtggccgcggagccgcgacaagatctggtaccacaacgtgccgcactcggagctcgcggcgtacaaggggcaccagaactgggtgaaggtctccggcgagtacctcaccttccccggcggcggcacgcagttcaagcacggcgcgctccactacatcgagctgatccagtcgtcgttcccggaggtggcgtgggggcggcgcagccgcgtcgcgctcgacgtgggatgcggcgtggcgagcttcggcggttacctgttcgaccacgacgtgctgaccatgtccctggcgcccaaggacgagcacgaggcgcaggtgcagttcgcgctggagcgcggcatcccggcgatctccgccgtcatggggacgcggcggctgccgttcccgagcaacgtgttcgacgcggtgcactgcgcgcggtgccgggtgccgtggcacatcgagggcgggatgctgctgctggagctcaaccggctgctccggcccggcgggttcttcgtctggtcggccacgccggtgtaccaggagctgccggaggacgtcgagatctggggagagatggtgaagctgacgaaggcgatgtgctgggagatggtgtcgaagacgagcgacacggtggaccaggtggggctcgtcacgttccggaagccggcggacaacgcgtgctatatgaagcgccgccagaaggagccgccgctctgcgagccctccgacgaccccaatgctgcttggaacataactttgcgggcgtgcatgcactgggtgcctacggacccatcggtgcgggggtcgtggtggccggagcggtggccggagaggatggagaagacgccctactggctgaacagcagccaggtcggggtgtacggcaagccggcgccggaggacttcgtggcggaccaggagcactggcggaaggtggtccggaactcgtacctcaccggcatgggcatcgactggaagacggtgaggaacgtcatggacatgagagccgtctacggagggttcgcggcggcgctgcgggacatgagcgtgtgggtgatgaacgtggtgacgatcaactcgccggacacgctgccggtgatctacgagagggggctgttcggcatctaccatgactggtgtgagtcattcagcacctacccgagatcctacgacctcctccatgccgaccatctcttctccaagctcaaatccaggtgcgaggtgttgccggtgatcgtggaggtggaccggatcctccggccgaacgggaagctcatcgtgagggacgacaaggagacggtggacgagatcaagggggtggtgaggtcgctgcaatgggaggtcaggatgaccgtctccaagaacagggaagcgatgctctgcgcgaggaagacgacgtggcggcccacggaagccgaggcaaga

SEQ ID NO: 440 - protein, 867 aa, Oryza sativa
  LOC_Os11g08314.1
MALFDRNQKQRSSLCSTATVVVFVALCLVGLWMISSPETIPAAAANVSKKPDVVAVKEEDSSLDATNNVKQNSANVVAETAAADEAAAADEDDNPAKPAAGEKAAAAAASSKDQTFDDENGRTEGGALVKPESGGGDEAASDVKEIGSLEQAAIDMKDTTEHSVGDTTKEPGVVQDKSSEEITMAASDARESSDGGGGGGAAKNKQTFDDENGKLDGVNLVKDVENKTMSEEGAKPLPEETTTVSSKNSIVAAAAMSDEKLTDNNGEQAQPVEALPNGQAELLTERAAQNGSFTTQAAESIKEKKKRAEKKKKKKKKVKAASVAAAAEEEGGGGGAASLGWRLCNTSAGADYIPCLDNEAAIKKLKTTAHYEHRERHCPASPPTCLVPSPEGYRDPIRWPRSRDKIWYHNVPHSELAAYKGHQNWVKVSGEYLTFPGGGTQFKHGALHYIELIQSSFPEVAWGRRSRVALDVGCGVASFGGYLFDHDVLTMSLAPKDEHEAQVQFALERGIPAISAVMGTRRLPFPSNVFDAVHCARCRVPWHIEGGMLLLELNRLLRPGGFFVWSATPVYQELPEDVEIWGEMVKLTKAMCWEMVSKTSDTVDQVGLVTFRKPADNACYMKRRQKEPPLCEPSDDPNAAWNITLRACMHWVPTDPSVRGSWWPERWPERMEKTPYWLNSSQVGVYGKPAPEDFVADQEHWRKVVRNSYLTGMGIDWKTVRNVMDMRAVYGGFAAALRDMSVWVMNVVTINSPDTLPVIYERGLFGIYHDWCESFSTYPRSYDLLHADHLFSKLKSRCEVLPVIVEVDRILRPNGKLIVRDDKETVDEIKGVVRSLQWEVRMTVSKNREAMLCARKTTWRPTEAEAR

SEQ ID NO: 441 - DNA, 2505 bp, Setaria italica
  Si028042m
atggccctgttcgaccggaaccagcggcagcggtcgtcgttctgctcgacggcgaccttcttcgtcgcgttcgtggcgctatgcctcctcggcctgtggatggccgccgtcaaggccgacgccaaggaggaggacagctccatcgacgccaccaacaccgtcaagcaggacagcgccaacgtcgtcgccgagacgaccgcggccgccgaagcctcccaggaggatcccgcgaagcccgctgctgaggacgccaagggcgacggcgacaaggcggcggcgtccaaagaccagacgttcgacgacgagaacggcaggacggagggcggggagctcgtgaagccggggaacggaggcgagacggacgccgccgcggcgcaggggaagggcgccgccgaggaggcatcggcggagaccgacggtaaggacgcgggcggcatggaccaggcgtccaccgacgccaaggaccagagcgccgagcaggcgtcgacggacaccaaggagagcgccgagcaggcggcggccgccgtggccggccgcggcacgcccaagaacctgacgttcgacgacgagaacgggaagatggacggcgtcgacctggtgaaggacgacggcaacaagacgcgcatctcggaggagagcgccaaggtcgaaggagccgcgctgacggtgaagccactggccaaagcggcggcggcgaccaccgacaccgacaccaccagcacggcggaggccctgccgaacgtccaggcggagctgttgacggagcgcgcggcgcagaacgggtcgttcacaacgcaggcggcggagtccaccgaggagaagaagaagcgcgccggcgccgagaagaaggccaaggggaataagaagaagaaggcgccgggcggaggcgcggcgacgccggcagggaagtggaagctgtgcaactcgagcgccggcgccgactacattccgtgcctggacaacgaggccgcgatcaagaagctcaagacggacaagcactacgagcaccgtgagcggcattgccccgccgagccgccgacgtgcctggtcccggcgccgccggcgtaccgcgacccaatccggtggccgcacagccgcgacaagatctggtaccacaacgtgccgcacacggcgctggccgagtacaaggggcaccagaactgggtgaaggtctccggcgagcacctaacgttccccggcggcggcacgcagttcaagcacggcgcgctccggtacatcgacctgatccaggccgcggcggcgccggagggggcggtggcgtggggccggcgcagccgcgtggtgctggacgtcggctgcggcgtggcaagcttcggcgggtacctgttcgaccgcgacgtgctgaccatgtcgctggcgcccaaggacgagcacgaggcgcaggtgcagttcgcgctggagcgcgggatcccggcgatctccgccgtgatgggcacccggcggcttccgttccccggcggcgtcttcgacgtcgtgcactgcgcacggtgccgcgtgccgtggcacatcgacggcggcatgctcctcctcgagctcaaccgcctgctccgccccggcggcgtcttcgtctggtccgccacgccggtctaccagaagctacccgacgacgtcgagatctgggacgagatggcgaagctgaccaaggccatgtgctgggagatggtggcgaagacgaagcacaccgtcgtcgacgaccaggtcggcgtcgccatcttccggaagccggagagaaacggctgctacgagaagaggccggagaaggcgccgccgctgtgcgagccctccgacgaccccaacgcggcgtggaacatcaagctgcgggcgtgcatgcaccgcgtgccggaggacccgtcggagcggggagcacggtggccggagccgtggccggagaggctggggaaggcgccgtactggctggacggcagccagacgggcgtgtacgggaagccggcgccggaggacttcgcggcggacctggagcactggaggaaggtggtgcggagctcgtacctcgccggcatgggcatcgactggaagacgatccggaacgtgatggacatgagggccgtctacggcgggctcgccgccgcgctacgggagatggaggtgtgggtgatgaacgtggtgaccatcgactcgccggacacgctgccggtaatctacgagcgcgggctgttcgggatctaccacgactggtgcgagtccttcagcacctacccgaggtcctacgacctcctccatgccgaccacctcttctccaagctcaagcccaggtgcaaggtgttgccggtggtcgtggaggtggacaggatcctgaggccgaatggcaagttcatcgtgcgggacgacaaggagacggtggacgagatccagagcgcggtgaggtcgttgcagtgggaggtcaggatgacagtgtccaagaacaaggaggcgatgctgtgtgcgaggaagacgacgtggcggcccacggaggtcgagagcaga

SEQ ID NO: 442 - protein, 835 aa, Setaria italica
  Si028042m
MALFDRNQRQRSSFCSTATFFVAFVALCLLGLWMAAVKADAKEEDSSIDATNTVKQDSANVVAETTAAAEASQEDPAKPAAEDAKGDGDKAAASKDQTFDDENGRTEGGELVKPGNGGETDAAAAQGKGAAEEASAETDGKDAGGMDQASTDAKDQSAEQASTDTKESAEQAAAAVAGRGTPKNLTFDDENGKMDGVDLVKDDGNKTRISEESAKVEGAALTVKPLAKAAAATTDTDTTSTAEALPNVQAELLTERAAQNGSFTTQAAESTEEKKKRAGAEKKAKGNKKKKAPGGGAATPAGKWKLCNSSAGADYIPCLDNEAAIKKLKTDKHYEHRERHCPAEPPTCLVPAPPAYRDPIRWPHSRDKIWYHNVPHTALAEYKGHQNWVKVSGEHLTFPGGGTQFKHGALRYIDLIQAAAAPEGAVAWGRRSRVVLDVGCGVASFGGYLFDRDVLTMSLAPKDEHEAQVQFALERGIPAISAVMGTRRLPFPGGVFDVVHCARCRVPWHIDGGMLLLELNRLLRPGGVFVWSATPVYQKLPDDVEIWDEMAKLTKAMCWEMVAKTKHTVVDDQVGVAIFRKPERNGCYEKRPEKAPPLCEPSDDPNAAWNIKLRACMHRVPEDPSERGARWPEPWPERLGKAPYWLDGSQTGVYGKPAPEDFAADLEHWRKVVRSSYLAGMGIDWKTIRNVMDMRAVYGGLAAALREMEVWVMNVVTIDSPDTLPVIYERGLFGIYHDWCESFSTYPRSYDLLHADHLFSKLKPRCKVLPVVVEVDRILRPNGKFIVRDDKETVDEIQSAVRSLQWEVRMTVSKNKEAMLCARKTTWRPTEVESR

SEQ ID NO: 443 - DNA, 2310 bp, Arabidopsis thaliana
  AT1G29470.1
atggcaatggggaagtattctcgtgtagacgggaagaagtcatcgggatatggcttaaccattaccatcgttttaattgtttctctatgtttggttggggcgtggatgttcatgtcttcatggtctgctccaactgagtctattgacttctctgcaaacgagaggacaaaagatgtagatactactaagagtgatttcaaaagtgaagaggttgatcgaggttccaagagttttccggatgaaaagaatgaggagacggaggttgtgacagagaccaacgaagagaagactgatcctgagaaatctggtgaggagaactctggtgagaaaacggagtcggctgaggaaagaaaggagtttgatgacaaaaatggtgatggggatagaaaaaatggagacggtgagaaagacacggaatcagaaagtgatgaaaccaagcaaaaagagaaaacacaactggaagagagctcagaagaaaacaaatctgaggatagtaatggaaccgaagagaatgctggtgaatctgaagaaaacaccgagaagaagtcagaagaaaacgctggtgaaactgaagagagcactgagaagagtaaggatgttttcccagctggtgaccaggctgaaatcacaaaggagtcaagcactggaagtggggcttggtctacccaattggtggaatcccagaacgagaagaaagcacaagtgtcctcaattaaatggaaagtctgcaatgtgacagctggaccagactacatcccttgccttgacaattggcaagctatcagaaagcttcattcgacaaagcattatgaacatcgtgagaggcattgtcccgaggagtctccacgctgccttgtttctcttcccgaagggtataagcgatccatcaagtggcctaagagcagagaaaagatctggtacaccaatattccacacaccaagcttgcagaagtcaagggacatcaaaactgggtgaagatgagtggtgaatacttaacattccctggtggaggtactcaattcaagaatggtgctcttcactacattgatttcctccaagagtcatatcctgatattgcttggggaaataggactcgtgttatattggatgttgggtgtggggttgctagctttgggggatatctttttgacagagatgtactcgctttgtcatttgcacccaaagacgaacacgaggcacaggtgcaatttgctctggaacgtggtattcctgcaatgtcaaatgttatgggaaccaagagattaccttttccaggatctgtttttgaccttatccattgtgctcgttgtagagttccttggcatatcgaaggtggtaaactacttttggagttgaaccgtgcattgaggccgggtggtttctttgtctggtcagcgactccagtctataggaagactgaggaagatgttggcatatggaaagctatgtcgaagctaacaaaggcaatgtgctgggaactgatgacgattaagaaagatgaactgaatgaagttggtgctgccatttaccagaagccaatgtcgaataaatgctacaatgaaagatctcaaaatgagccacctctctgcaaagactctgatgatcaaaatgccgcctggaatgttccacttgaggcatgtattcacaaagtaacagaagattcatcaaaacgcggagcagtttggcctgaaagttggccggaaagagtggagacggttcctcagtggttagattctcaggaaggagtatatggaaaacctgcacaagaggatttcacagcagaccatgaacgctggaagactattgtttcaaagtcatacctcaacggtatgggaatcgattggtcttatgttagaaatgtgatggacatgagagcagtctatggaggttttgctgctgcattgaaggatctgaaactgtgggtgatgaatgtagttcctatcgactcacctgatacccttccgattatatacgaacgtggtttgtttggaatctatcatgattggtgtgaatcattcagcacttaccctcggacttacgacctccttcacgctgatcatcttttctcttcactgaaaaagaggtgcaacttggtgggcgtgatggctgaagtagaccggattcttagaccacaaggaactttcatagtaagagatgacatggaaacgataggagaaattgagaagatggtgaaatcgatgaaatggaatgtaagaatgacacattccaaagatggagaaggattgctctctgttcagaagtcatggtggcgtcctacagaggccgagaccattcagtcggcaatagct

SEQ ID NO: 444 - protein, 770 aa, Arabidopsis thaliana
  AT1G29470.1 (PMT24, NP_174240, G837)
MAMGKYSRVDGKKSSGYGLTITIVLIVSLCLVGAWMFMSSWSAPTESIDFSANERTKDVDTTKSDFKSEEVDRGSKSFPDEKNEETEVVTETNEEKTDPEKSGEENSGEKTESAEERKEFDDKNGDGDRKNGDGEKDTESESDETKQKEKTQLEESSEENKSEDSNGTEENAGESEENTEKKSEENAGETEESTEKSKDVFPAGDQAEITKESSTGSGAWSTQLVESQNEKKAQVSSIKWKVCNVTAGPDYIPCLDNWQAIRKLHSTKHYEHRERHCPEESPRCLVSLPEGYKRSIKWPKSREKIWYTNIPHTKLAEVKGHQNWVKMSGEYLTFPGGGTQFKNGALHYIDFLQESYPDIAWGNRTRVILDVGCGVASFGGYLFDRDVLALSFAPKDEHEAQVQFALERGIPAMSNVMGTKRLPFPGSVFDLIHCARCRVPWHIEGGKLLLELNRALRPGGFFVWSATPVYRKTEEDVGIWKAMSKLTKAMCWELMTIKKDELNEVGAAIYQKPMSNKCYNERSQNEPPLCKDSDDQNAAWNVPLEACIHKVTEDSSKRGAVWPESWPERVETVPQWLDSQEGVYGKPAQEDFTADHERWKTIVSKSYLNGMGIDWSYVRNVMDMRAVYGGFAAALKDLKLWVMNVVPIDSPDTLPIIYERGLFGIYHDWCESFSTYPRTYDLLHADHLFSSLKKRCNLVGVMAEVDRILRPQGTFIVRDDMETIGEIEKMVKSMKWNVRMTHSKDGEGLLSVQKSWWRPTEAETIQSAIA

SEQ ID NO: 445 - DNA, 2310 bp, Arabidopsis thaliana
  AT2G34300.1
atggcgatggggaagtattcccgtgtagacgggaagaaatcatcgagctatggtttaaccattaccattgttctgttactttccctctgtttagttgggacatggatgttcatgtcttcttggtcagcccctgctgattctgctggctactcctcaactgatactgctaaagatgtttctaagaatgacttgagaaaagaagaaggcgatcgagatccgaagaacttttctgatgaaaagaatgaagaaaatgaggctgcgactgagaacaaccaagtgaagactgattctgagaactctgctgagggaaaccaggtcaatgagagctctggcgagaaaactgaagcaggcgaggaaagaaaagagtctgatgacaacaatggtgatggagatggggagaaagagaagaatgtgaaagaagtaggatccgaaagtgatgaaacaacgcagaaagagaaaacgcaactggaagagagcacagaagaaaataagtccgaggatggtaatggcaacgaagagaaggctgaagagaatgctagtgaaactgaagaaagcacggagaagagtagcaaggaagtctttccagctggtgaccaggctgaaattacaaaagagtcgagcactggagatggagcttggtcaacccaattggttgagtcgcagaacgagaagaaagcacaacagtcctcgatatctaaggaccaaagtagctatggatggaaaacgtgcaatgtgactgctggtccagactacatcccttgccttgacaattggcaggctatcaaaaagcttcatactacaatgcactatgaacatcgcgagcgccattgtcctgaggaatctcctcattgtcttgtgtctctgcctgatggttataagcggtccatcaagtggccaaagagcagggaaaagatctggtacaacaatgttccccacaccaagcttgcagagatcaaggggcatcaaaattgggtgaagatgagtggtgaacatctgacgttccctggtggtggtactcagtttaagaatggtgctcttcattacattgatttcatccaacagtcacatcctgctattgcatggggaaatagaacccgtgttatattggatgtcggatgtggagttgctagctttggtggttaccttttcgaaagagatgtgcttgctttgtcatttgctcccaaagatgagcatgaggcgcaagtgcaattcgcgctggaacgtggtattcctgcaatgttaaacgttatgggaaccaaaagattaccgtttcccggttctgtttttgaccttatccattgtgctcgttgtagagtcccttggcatattgaaggtggtaaacttcttttggaattgaaccgtgctttgaggccgggtggtttctttgtctggtcagcgactccagtctatagaaagaacgaggaagattctggtatatggaaagcaatgtcggaactcacaaaggcaatgtgctggaagctggtgacaattaagaaagacaaactgaatgaggttggtgccgccatataccaaaagccaacttcaaataaatgttacaacaaaagacctcaaaatgagccacctctctgcaaggattccgatgatcaaaatgcagcctggaatgttccacttgaggcatgtatgcataaagtgacagaagattcatcaaagcgaggagcagtgtggccaaacatgtggccagagagggttgaaactgcgcctgagtggttggattcgcaggaaggtgtttatggaaaacctgcaccagaagatttcacagcagaccaagagaagtggaaaactattgtctcaaaggcataccttaatgacatgggaatcgattggtctaatgtgagaaacgtgatggacatgagagcagtctatggaggatttgctgctgcgttgaaggatttgaagttatgggtgatgaacgtggttcctgtggatgcgccagatacacttcccatcatatatgaacgtggtttatttggaatctatcatgactggtgtgaatcattcaacacttatcccagaacttacgaccttctccatgccgatcatcttttctctaccctgaggaagaggtgcaatttggtgtcggtaatggctgagattgatcggattcttaggccacaaggaactttcatcataagggatgacatggaaacattaggagaagttgagaaaatggtgaaatctatgaaatggaaggttaaaatgacgcagtccaaagacaatgaaggcttgctttcaattgaaaagtcatggtggcgtcctgaagaaactgagacaatcaaatcggcaatcgct

SEQ ID NO: 446 - protein, 770 aa, Arabidopsis thaliana
  AT2G34300.1
MAMGKYSRVDGKKSSSYGLTITIVLLLSLCLVGTWMFMSSWSAPADSAGYSSTDTAKDVSKNDLRKEEGDRDPKNFSDEKNEENEAATENNQVKTDSENSAEGNQVNESSGEKTEAGEERKESDDNNGDGDGEKEKNVKEVGSESDETTQKEKTQLEESTEENKSEDGNGNEEKAEENASETEESTEKSSKEVFPAGDQAEITKESSTGDGAWSTQLVESQNEKKAQQSSISKDQSSYGWKTCNVTAGPDYIPCLDNWQAIKKLHTTMHYEHRERHCPEESPHCLVSLPDGYKRSIKWPKSREKIWYNNVPHTKLAEIKGHQNWVKMSGEHLTFPGGGTQFKNGALHYIDFIQQSHPAIAWGNRTRVILDVGCGVASFGGYLFERDVLALSFAPKDEHEAQVQFALERGIPAMLNVMGTKRLPFPGSVFDLIHCARCRVPWHIEGGKLLLELNRALRPGGFFVWSATPVYRKNEEDSGIWKAMSELTKAMCWKLVTIKKDKLNEVGAAIYQKPTSNKCYNKRPQNEPPLCKDSDDQNAAWNVPLEACMHKVTEDSSKRGAVWPNMWPERVETAPEWLDSQEGVYGKPAPEDFTADQEKWKTIVSKAYLNDMGIDWSNVRNVMDMRAVYGGFAAALKDLKLWVMNVVPVDAPDTLPIIYERGLFGIYHDWCESFNTYPRTYDLLHADHLFSTLRKRCNLVSVMAEIDRILRPQGTFIIRDDMETLGEVEKMVKSMKWKVKMTQSKDNEGLLSIEKSWWRPEETETIKSAIA

SEQ ID NO: 447 - DNA, 2451 bp, Populus trichocarpa
  POPTR_0002s07640.1
atgcctatgggaaaatattcccgtgttgatgggaggaagtcatccaactactgttctacaaccactgtggttgtgtttgttgctttgtgtttagttggggcttggatgtttatctcatcatctgttccagttcaaaactcagacccatcatcccaagagaatgtgaaacgagtggctggtgaaaatatttctaagcattttgaagacattcctggtgatttaccggaggatgcaacaaaagaagatggcaatgctgttgattctcaaagtgctagccaatctgatgtccatgatgacccaaaggtgactgaaaaagagagtgaaagtactgttgaggataacaaagatgagaacagggatgagaaggccgagtctaagaatgtggtagaagaaaaccaggatgggaagactgtttctgaagaggaacgaaagatggagactgaaaataatgaggatggaaaaacagaggatagagagttgaattcaagtgataaagaatcaaattcagaagctggagagacccaagctcaaggcaatgaagcaaatgaaagcgatcaaacagaatcagaggagagctcaggtgaaaataaatccaagtcagatgatggggagaagaacccagactcaggggagaatgcaaatgaaaataaccaggaaggtgctattgagaataacgtggatagtcaagagaatgatcaaacttccattgagattttacctgctggcacacagtcagaacttctaaatgaaaccaatactcgaaatggggcttggtcgactcaagtggtggagtcacagaatgagaagatatctcaacaatcttcaatagctaaggatcaatatggtcatggatggaaactttgtaatgtcactgctggaccagcctatgttccttgccttgataattggtacgttataagaaggcttccaagcacaaagcactatgaacatcgagagaggcactgtcctcaagaagctcccacttgtttggtacccatacctgaaggatatagacgctcagttaagtggcctaaaagcagggaaaagatatggttctataatgtccctaacaccaagcttgccgaggttaaggggcatcagaattgggttaaagttgctggtgaatatcttacttttccaggtggtggaactcagttcaagcatggtgctcttcattatattgatttcattcaggattctcatcctgatattgcatggggaaaaagaagccgagtgatattggatgttgggtgtggggtggcaagctttggaggttatcttttggaaaaagatgttcttgcaatgtcatttgctcccaaggatgaacatgaagcccaggttcaatttgcacttgaaaggggtatccctgcgatgttggctgttatgggcacaaagagattaccctttcctaattctgtttttgatcttgttcattgtgcacgctgtagggttccttggcacattgaaggtggtaaacttcttttggagctgaatcgggtgttgaggcctggtggttactttgtctggtctgccaccccagtttatcgaaagcgtccagaagatgtgggcatttggaaagcaatgtccaaactaacaaagtcaatgtgctgggatctggtggtgattaaaacggacacgctaaatggtgttggtgcagcaatatatagaaagccaacttccaatgactgctataataatagaccgcaaaatgagcctccactgtgcaaagaatctgatgatccaaatgcagcgtggaatgtcctgctcgaggcatgtatgcataaagtgcctgtagatgcgtcagtgcgtgggtctcattggcctgagcaatggccaaaacggctggagaaaccaccatactggttgaattctcaggttggagtttatggtaaagctgctgcagaggattttgctgctgactataaacattggaaaaatgttgtctcccagtcttatttgaatgggataggaatcaactggtcttctgtgagaaatatcatggacatgagagctgtatatggagggtttgctgcggcactgaaagacttgaaagtgtgggttatgaatatagtcccaattgactctgcagacacgcttccaatgatctatgagcgtggtttgtttggaatgtatcatgattggtgtgaatcattcaatacctatcctagaacttatgatcttctccatgctgatcatctcttctccagtctaaaaaagaggtgcaacttagtggcagtaatagcagaagttgatcggatcctgaggccagaaggaaagctgattgtgcgtgacaatgttgaaatcattggtgagattgagagcctggccaaatctctgaaatgggagatccggatgatttactcaaaagacaatgagggactgctttgtgttcaaaagacaacgtggcgtcctacggaatcggaaacaataacatcagccatcatacaagcc

SEQ ID NO: 448 - protein, 817 aa, Populus trichocarpa
  POPTR_0002s07640.1
MPMGKYSRVDGRKSSNYCSTTTVVVFVALCLVGAWMFISSSVPVQNSDPSSQENVKRVAGENISKHFEDIPGDLPEDATKEDGNAVDSQSASQSDVHDDPKVTEKESESTVEDNKDENRDEKAESKNVVEENQDGKTVSEEERKMETENNEDGKTEDRELNSSDKESNSEAGETQAQGNEANESDQTESEESSGENKSKSDDGEKNPDSGENANENNQEGAIENNVDSQENDQTSIEILPAGTQSELLNETNTRNGAWSTQVVESQNEKISQQSSIAKDQYGHGWKLCNVTAGPAYVPCLDNWYVIRRLPSTKHYEHRERHCPQEAPTCLVPIPEGYRRSVKWPKSREKIWFYNVPNTKLAEVKGHQNWVKVAGEYLTFPGGGTQFKHGALHYIDFIQDSHPDIAWGKRSRVILDVGCGVASFGGYLLEKDVLAMSFAPKDEHEAQVQFALERGIPAMLAVMGTKRLPFPNSVFDLVHCARCRVPWHIEGGKLLLELNRVLRPGGYFVWSATPVYRKRPEDVGIWKAMSKLTKSMCWDLVVIKTDTLNGVGAAIYRKPTSNDCYNNRPQNEPPLCKESDDPNAAWNVLLEACMHKVPVDASVRGSHWPEQWPKRLEKPPYWLNSQVGVYGKAAAEDFAADYKHWKNVVSQSYLNGIGINWSSVRNIMDMRAVYGGFAAALKDLKVWVMNIVPIDSADTLPMIYERGLFGMYHDWCESFNTYPRTYDLLHADHLFSSLKKRCNLVAVIAEVDRILRPEGKLIVRDNVEIIGEIESLAKSLKWEIRMIYSKDNEGLLCVQKTTWRPTESETITSAIIQA

SEQ ID NO: 449 - DNA, 2478 bp, Populus trichocarpa
  POPTR_0005s20670.1
atggctatgggaaaatattcccgtgttgatgggaagaagtcatccaactactgttctacaatcactgtggttgtgtttgttgctttgtgtttagttggggcttggatgtttatgtcatcatctgtttcagttcaaaattcagactcgtcttcccaagagaaagtgaatgatgtgaaacgagtggctggcgaaaataattctaagcaatttgaagacagtcctggtgatttaccggatgatgcaaccaaagaagatgggaacactgttgattctcaaagtgatagccaatctgatgtccatgaagaccaaaatgtgactgaaaaagagagtgaaggtacagttgaggataacaaggatgagaagactgagtctaagaatatggttgaagaaaaccaggatgagaagactgagtctaagaatatggttgaagaaaaccaggatgagaagactgaatctcaagaggaaccaaagacagagactgaaaaggatggaaaaacagaggatagagggtcaaattcaggagatggagaatcaaattcagaagctggagagatgccagctcaaggtgatgaaacaaataaaagcgagcaaacagaatcagaggagagctcaggtgaaaataaatccgagttggacgagggggagaaaaactcagactcaggagagagtgcaaatgaaaataaccaggatggtgctactgagaataacgtggatagtcaagagaatgatcaaacttccattgagattttacctgccggtgcacaatcagaacttctaaatgaaactaatactcaaaatggggcttggtcaactcaagtggtggagtcacagaaagagaagatatcgcaacaatcttcaatatctaaggatcaaaatggtcatgcatggaaactttgtaatgtcactgctggaccagattacgtcccttgccttgataattggtatgttataagaaggctttcaagcacaaagcactatgaacatcgagagaggcactgccctcaagaagcccccacttgtctggtatccatacctgaaggatatcgacgctcaattaagtggcctaaaagcaaggataagatatggtactataatgttccccacaccaagcttgctgaggttaagggacatcagaattgggttaaacttactggtgaatatctgacttttcctggtggtggaactcagttcaagcacggtgctcttcattatattgatttcatccaggattcacatcctgatattgcatgggggaaaagaaccagagtgatattggatgttgggtgtggggtggcaagctttggaggttatctttttgaaagagatgttcttgcaatgtcatttgctcccaaggatgaacatgaagctcaggttcaatttgcacttgaaaggggaatccctgcaatgttggctgttatgggcaccaagagattaccctttcctagttctgtttttgatgttgttcactgcgcacgctgtagggttccttggcatgttgaaggtggtaaacttcttttggagctgaatcgagttttgcgacctggtggttactttgtctggtctgccaccccagtttatcaaaagcttccagaagatgtgggcatttggaaagccatgtccaaactaacaaagtcaatgtgctgggatctggtggtgattaaaaaggacaaactaaatggtgttggtgctgcaatatttagaaaaccaacttccaatgactgttataataatagaccccaaaatgagcctccactgtgcaaagaatctgatgatccaaatgcagcatggaatgtcccacttgaggcatgcatgcataaagtgcctgaagatgcatcagtgcgtgggtctcgatggcctgagcaatggccacaaaggctggagaaaccaccgtactggctgaattctcaggttggagtttatggtaaagctgcgccagaggattttgctgctgactatggccactggaaaaatgttgtttccaaatcttatttgaatggaatgggaatcaactggtcttctgtaagaaatatcatggacatgagagctgtatatggagggtttgctgcggcactgaaagatttgaaagtgtgggttatgaatgtagtcccaattgactctgcagacacgcttccaataatttacgagcgtggtttatttggaatgtatcatgattggtgcgaatcattcaacacctatcctagaacttacgatcttctccatgccgatcatctcttttccagtctcacaaagaggtgcaacttagtggcagtaatagcagaagttgacaggatactgaggccagaaggaaatctgatcgtgcgtgacaatgttgaaatcattggtgagattgagagcctggccaaatctctgaactgggatatccggatgatttactcaaaagacaatgagggactgctttgtgttcacaagacaatgtggcgtcctacagagccagaaacaataacgtcagccattata

SEQ ID NO: 450 - protein, 826 aa, Populus trichocarpa
  POPTR_0005s20670.1
MAMGKYSRVDGKKSSNYCSTITVVVFVALCLVGAWMFMSSSVSVQNSDSSSQEKVNDVKRVAGENNSKQFEDSPGDLPDDATKEDGNTVDSQSDSQSDVHEDQNVTEKESEGTVEDNKDEKTESKNMVEENQDEKTESKNMVEENQDEKTESQEEPKTETEKDGKTEDRGSNSGDGESNSEAGEMPAQGDETNKSEQTESEESSGENKSELDEGEKNSDSGESANENNQDGATENNVDSQENDQTSIEILPAGAQSELLNETNTQNGAWSTQVVESQKEKISQQSSISKDQNGHAWKLCNVTAGPDYVPCLDNWYVIRRLSSTKHYEHRERHCPQEAPTCLVSIPEGYRRSIKWPKSKDKIWYYNVPHTKLAEVKGHQNWVKLTGEYLTFPGGGTQFKHGALHYIDFIQDSHPDIAWGKRTRVILDVGCGVASFGGYLFERDVLAMSFAPKDEHEAQVQFALERGIPAMLAVMGTKRLPFPSSVFDVVHCARCRVPWHVEGGKLLLELNRVLRPGGYFVWSATPVYQKLPEDVGIWKAMSKLTKSMCWDLVVIKKDKLNGVGAAIFRKPTSNDCYNNRPQNEPPLCKESDDPNAAWNVPLEACMHKVPEDASVRGSRWPEQWPQRLEKPPYWLNSQVGVYGKAAPEDFAADYGHWKNVVSKSYLNGMGINWSSVRNIMDMRAVYGGFAAALKDLKVWVMNVVPIDSADTLPIIYERGLFGMYHDWCESFNTYPRTYDLLHADHLFSSLTKRCNLVAVIAEVDRILRPEGNLIVRDNVEIIGEIESLAKSLNWDIRMIYSKDNEGLLCVHKTMWRPTEPETITSAII

SEQ ID NO: 451 - DNA, 2475 bp, Eucalyptus grandis
  Eucgr.F04285.1
atggcttcaggaaacattcgtctatttgatgtgcggaaatcaccaaactactgttcaaggatttctttagttgtgtttgttgcttttagtttatttgcaatctggattttcctgccatcatcttccacatttccagttgagaatccgaacttactatatcaagagaatgatagtttgggacacagagtaaataatggaagcttggggaatactcagattcaaagccaggatgttccagatgatgataaaaggacagttaaaaagggttcagaagatgcaggtgagcaaaccaaggttgattctgctaagacactggagactgacctggaagagaaaatatcagaagagagcactcctgggaagacttcctctgagaaaacttctgacaaatctgatatgacttctgaatttgacaatgaaactgaggatggacagatgaataaccaacacaagagcaatgagagtagagagaaaccaaatatgggaatgagcaatactgatggaggtcaaaaggatggagagcaaacattggctgatgaagaatctgatttggatgaaaagttcaatagctcaaaaggaaaagattctgacatagatgatggtgccgaaaaactgaacactgataatagcttagatgacgttcagcaggacaataaaaaggtcaaccagaatagtgagagggtccagcaagatcaagacaataattctgaacaacctgctgctaacaataacctaggaatccaggaaagaactcaggaatctaataatcagtcagaaaatttggctcaaacaactgcttcagacggcacttggtcaactcaagtggtggagtcccaaaatgagaagctgtcacaacaagattcaaaggaacaaaatgactacacctggaaagtttgtaacaccacggctgggccagactacatcccttgcctcgacaatgtgcatgctgttagaaggcttcctagtacaatgcattttgaacatcgagagaggcactgccctgaagatgctcctacatgtcttgttcctctacctgcaggatacaggaagccaattcaatggcccaaaagcagggataagatatggttccacaatgttccacatactgagctcgctgtagtcaaaggacatcaaaattgggttaaagttactggtgaatatcttacatttcccggtggtggaactcaatttattgagggtgctctccactatattgatatgattcaaaatgcaaatcctgctattgcatgggggaagagaagccgggtgatattagatgtcggatgcggtgtagccagtttcggaggttatttatttgaaagggatgttcttacaatgtcttttgctcccaaagacgtgcatgaagctcaagttcaatttgcacttgaacgtggtattccagccatacttggggttatgggaaccaagaggctaccatttcccggtggtgtttttgatgttatccactgtgcccgctgtagagtcccttggcatattgaaggtggcaaacttctcttggagctcaaccgtgtcctacgaccaggtggttactttctttggtctgctactccaatttatcgaagggaccaagaagacattggcatttggaaagaaatgtccaaactgactatggctatgtgctgggatcttgtcatgattaaaaaggacaaactgaataaagtcgccattgcaatgtacaggaaaccaacatctaatgagtgctatgaaaagagaccacaaaatgagcctccactctgtgataatttcgatgatcctaactcagcttggaatgtgacgctgcaagcctgcatgcataaagtgcctgtggacatgtcaaagcgtgggtccaattggcctgagaaatggccagtacgtttagaaaaaccaccatactggctgaatgaactcggagtatatggaaaaccgggccaagaagattttactgctgactacgagcactggaaagatattgtctcccaaacatatatgaatggcattggtgtcagttggtcttctatcaggaatatcatggatatgagagctgtatatggagggtttgctgctgccctcaaagacttgaaagtttgggtgatgaatgtaatcccgattgaatctcctgacacacttcctataatatatgaacgcggtttatttggcatgcaccatgattggtgtgaatcatttaacacctacccaagatcttatgatcttctccatgcagataatctcttctccagtctcaaaaagaggtgcaacttgatgccagtttttgcagaagttgatcggattctgaggccagaaggaattctcattgtcagggataatgcggcaactatagctgagattgagagtattgctaaatctctgcaatgggatgtcagattcacagactcgaaagacaatgaggggttgctctctgttcagaagacattttggcgtcctttagatgtggaaacaattacttcagcaattgcc

SEQ ID NO: 452 - protein, 825 aa, Eucalyptus grandis
  Eucgr.F04285.1
MASGNIRLFDVRKSPNYCSRISLVVFVAFSLFAIWIFLPSSSTFPVENPNLLYQENDSLGHRVNNGSLGNTQIQSQDVPDDDKRTVKKGSEDAGEQTKVDSAKTLETDLEEKISEESTPGKTSSEKTSDKSDMTSEFDNETEDGQMNNQHKSNESREKPNMGMSNTDGGQKDGEQTLADEESDLDEKFNSSKGKDSDIDDGAEKLNTDNSLDDVQQDNKKVNQNSERVQQDQDNNSEQPAANNNLGIQERTQESNNQSENLAQTTASDGTWSTQVVESQNEKLSQQDSKEQNDYTWKVCNTTAGPDYIPCLDNVHAVRRLPSTMHFEHRERHCPEDAPTCLVPLPAGYRKPIQWPKSRDKIWFHNVPHTELAVVKGHQNWVKVTGEYLTFPGGGTQFIEGALHYIDMIQNANPAIAWGKRSRVILDVGCGVASFGGYLFERDVLTMSFAPKDVHEAQVQFALERGIPAILGVMGTKRLPFPGGVFDVIHCARCRVPWHIEGGKLLLELNRVLRPGGYFLWSATPIYRRDQEDIGIWKEMSKLTMAMCWDLVMIKKDKLNKVAIAMYRKPTSNECYEKRPQNEPPLCDNFDDPNSAWNVTLQACMHKVPVDMSKRGSNWPEKWPVRLEKPPYWLNELGVYGKPGQEDFTADYEHWKDIVSQTYMNGIGVSWSSIRNIMDMRAVYGGFAAALKDLKVWVMNVIPIESPDTLPIIYERGLFGMHHDWCESFNTYPRSYDLLHADNLFSSLKKRCNLMPVFAEVDRILRPEGILIVRDNAATIAEIESIAKSLQWDVRFTDSKDNEGLLSVQKTFWRPLDVETITSAIA

SEQ ID NO: 453 - DNA, 2430 bp, Eucalyptus grandis
  Eucgr.F04286.1
atggcttcaggaaattggtctctatccgatgtgaggaaatcatcaaatcactgttcaaggcttgctgtagttgtgtttgttgcttttagtttatctgcgatttggatattccttccatcttcgactacgttcccggttcagaaccctgacttgctacatcaagagaataataatttgggacaaaaagtaaccgatggaagctcgggaaattctcagattcaaagccaggatgttgtaaacaatgacgaaagatcagttgaaacagagtcggggaacacagttcagccaaccaaggctgattctgctaatagagcggggactaaccaggaagagaaaataccaaaggagagctctaatatgaagacttcctcagaaaacaaacctgaaaaatctgacattgagtctaaatttgaggatgaaacggaggatatacagaaaagtaaccatcacaagggcgttgagactggagagaaaccaaatatggaaatgagaaatacagatggaggtcaaaatggtggagagcaaactatggccagtgaaggatctgattctgatgaaaagttgaatagctcaaaaggaaatgattctgacatggatgatagcaccaaaagactgaatgctcaggatagcttagatgaggttaagcaggaagaaaaagaggtcaatcagaatagtcagagggtttgggaagatcaagacaagaatagtgaaccacaagttgctgacaataacctagaaactcaggaaatgcttcaggagtctaatgatcattcggatagttcgaatgagataactgctcagcaagagtcaatgtctaaggaacagaatgactatgtctggagagtttgtaataccacggctgggccagactacattccttgccttgacaatgtgtatgctgtcagaaggcttcctactacaatgcattatgaacatcgagagaggcactgccctgataatcctcctgcctgtcttgttcctctaccagcaggatacagaaaacctattcaatggcctgttagcagggataagatatggttttataatgtgccacataccgaccttgctagggtcaagggaggtcaaaactgggttaaagttgctggtgaatatctcatattccctggaggtggtacccagtttgttcatggcgctatcccctatattgatcggattgaagctgcaaaacctgctattgcatgggggaagagaacccgggtgatattagatgttggatgtggtgttggcagtttcggaggttatttatttgaaagggatgttcttaccatgtcgtttgctcccaaagatgaacatgaagctcaagttcagttcgcacttgaacggggtattccagccatgctagcagtcatgggcaccaaaaggctaccatttcctagtggtgtttttgatgctattcactgtgctcgctgtagagtcccttggcacattgaagggggcaaacttctcttggagcttaaccgcctcttacggccaggtggttactttgtttggtctgctactccaatttatcgaaagggtccagaagatcttggcatttggaaagaaatgtccaaactgactacagctatgtgctggaacttcacgttgattaaaaggaaggacaaaatgaacaaagtgtccattgcactgtacaggaaaccgacatctaatgagtgcattgagagtagaaccaaaaatgaacctccactctgcaatggcttggacgatgcaaactcaacttggaatgtgacactgcaagcctgcatgcataaggtgcctacagacatgtcggaacgtgggtctcaatggcctgagaactggctgcatcgtttgggaaaaccaccttactggctgaataaagtcgcagtaaatggcaaggcgacccaaggagattttactgctgactatgagcactggaaaaatataatctcccaaacatatttaaatgggataggtgtcagctggtcttctattaggaatgtcatggacatgagagctgtctatggagggtttgctgctgcgctgaaggacttaaaagtgtgggtaatgaatgtagtcccgatcgactctcctgacacacttcctataatctatgagcgtggtttaattggaatataccatgattggtgtgaatcattcaacacttacccaagatcgtatgatctcctccatgcagataatttgtttgccactctcaagaagaggtgcaagttagtgccagttcttgctgaagttgatcggatcttgaggccagaaggaattctaattgttagggatgatatggaaattatatctgagattgagagtatggctaaatctctgcaatgggaggtcagattcacacactcagaggacaacacggggttgctttgtgttcagaagacattttggcgccctgtcaatgtggaaacaattgcttcagccattgct

SEQ ID NO: 454 - protein, 810 aa, Eucalyptus grandis
  Eucgr.F04286.1
MASGNWSLSDVRKSSNHCSRLAVVVFVAFSLSAIWIFLPSSTTFPVQNPDLLHQENNNLGQKVTDGSSGNSQIQSQDVVNNDERSVETESGNTVQPTKADSANRAGTNQEEKIPKESSNMKTSSENKPEKSDIESKFEDETEDIQKSNHHKGVETGEKPNMEMRNTDGGQNGGEQTMASEGSDSDEKLNSSKGNDSDMDDSTKRLNAQDSLDEVKQEEKEVNQNSQRVWEDQDKNSEPQVADNNLETQEMLQESNDHSDSSNEITAQQESMSKEQNDYVWRVCNTTAGPDYIPCLDNVYAVRRLPTTMHYEHRERHCPDNPPACLVPLPAGYRKPIQWPVSRDKIWFYNVPHTDLARVKGGQNWVKVAGEYLIFPGGGTQFVHGAIPYIDRIEAAKPAIAWGKRTRVILDVGCGVGSFGGYLFERDVLTMSFAPKDEHEAQVQFALERGIPAMLAVMGTKRLPFPSGVFDAIHCARCRVPWHIEGGKLLLELNRLLRPGGYFVWSATPIYRKGPEDLGIWKEMSKLTTAMCWNFTLIKRKDKMNKVSIALYRKPTSNECIESRTKNEPPLCNGLDDANSTWNVTLQACMHKVPTDMSERGSQWPENWLHRLGKPPYWLNKVAVNGKATQGDFTADYEHWKNIISQTYLNGIGVSWSSIRNVMDMRAVYGGFAAALKDLKVWVMNVVPIDSPDTLPIIYERGLIGIYHDWCESFNTYPRSYDLLHADNLFATLKKRCKLVPVLAEVDRILRPEGILIVRDDMEIISEIESMAKSLQWEVRFTHSEDNTGLLCVQKTFWRPVNVETIASAIA

SEQ ID NO: 455 - DNA, 2502 bp, Glycine max
  Glyma04g42270.1
atggcgctgggaaagaattcccgaggtgaggggaggaagttgtcgaactactgttcaacggtctctgtcgctgtgttcgttgcattttgtttagttggtgtatggattgtaatgtcatccattgttccaattcagaattcagtcattcaggtatctgagactgataccattaatgatgttaaaaatgtagcaagtgattccaagcaatttgaagacagatctggtgatatatcagaagaatcaacacagggagatagccagactaaaaaatctcagagtggtgatagccatccagaaaacctggatgaccaaaagggaattgaaaaagtgtctgataataccgaggaagaaaaccaggaggctgttggggacaactcagatgaaaagaatgatttggaggagggtctggggaatactattgaggagaatgatcaaatgaggaatgtcaagccgagcactgacgagaaggagaaagaatcagatggaagcttaaattcagaatccaaagaaacatcaaatgatcaaattcatgatgatgaacttaaaggatcaatggaaactttagatgaaaaagaatctgacaagagcgcaaatgataacaaattagggacagaaaagagtaagggtgaagtcacacaacaagatgagatggttggtgagactgaggaggagaaaataaagaaaaatctgcattcagagacaacacaaagtactggagggagtaacacagaaagccatgaaaacaatccagctttaaaagaagtttctattactggtaccccatcagaaactttgattgaaactagcactgaaaatggaacatggtcaactcaagctgcagagtcacagcatgagaaggaatcacagaagtcttcggtttctattgacagcagaacatatgactggaaactttgtaatacaactactggatcagagtacattccttgccttgacaattggcaagcaattagaaagcttcagagcataaggcactatgaacatcgtgagaggcactgtcctgatgaagctaccacttgtcttgtttctctgcctgagggttatagaagcccaattaggtggcccaaaagcagggaaatgatatggtacaacaatgctccacacacaaaacttgtcgtagataagggtcatcaaaactgggtcaaagttactggtaaataccttacttttccaggtggtggaactcagtttaaacatggtgctcttcattacattgaattcattcagaaatctcttcccaaaattgcatgggggaagagaagtcgtgtgatattggatgttgggtgtggggtagccagctttggaggctatctgtttgaaaaagacgttctgaccatgtcatttgctccaaaagatgtgcatgaggcacaagtgcaatttgcactggaacggggaattcctgccacattaggtgtcatgggcactgtaagattaccctaccccggttctgtctttgatcttgtccactgtgctcgttgtagagtcccttggcacatagaaggtggcaagttgctcttagagcttaatcgtgtcttacgacctggaggtcactttgtatggtctgctactccagtgtatcaaaaggatccagaggatgttgagatttggaaagcaatgggtgaaattacaaagtcaatgtgctgggatctggtggtaattgcaaaggacaaattgaatggagtggcagcagcaatatatagaaaaccaactgacaatgagtgctataacaacagaataaaacatgagccaccaatgtgcagcgaatctgatgatccaaatacagcctggaatgtatcactacaggcttgtatgcacaaagtgcccgtagatgcatcagagcgtggatcaatctggcctgagcaatggccactgaggttggagaaaccaccttactggatagactctcaggctggtgtttatggaagagctgcatcagtggaattcactgctgattacaagcattggaaaaatgttatttcccactcgtatttgaatggaatgggtatcaattggtcttcagtaagaaatgtcatggacatgaaagctgtctatggaggctttgctgcagcactcagagccctgaaagtgaatgtttgggtaatgaatgtggttccaattgattctccagacacactgccaataatatatgagcgtggattattcggtatttatcatgattggtgtgaatcattgaatacttaccctagatcatatgatcttctgcatgccgactctatattctcaacacttaaggaaaagtgcaacatactggcagtgattgcagaagttgataggatcctgagaccagaaggatatttggtcataagagacaatgttgaaactattggcgagatagagagcatggctaaatctctacactgggatattcagttgacatattccaaaaatggggagggattcctttgcattcagaagacattctggcgtccaacaaaggttgaaacagttgcatcagccattgca

SEQ ID NO: 456 - protein, 834 aa, Glycine max
  Glyma04g42270.1
MALGKNSRGEGRKLSNYCSTVSVAVFVAFCLVGVWIVMSSIVPIQNSVIQVSETDTINDVKNVASDSKQFEDRSGDISEESTQGDSQTKKSQSGDSHPENLDDQKGIEKVSDNTEEENQEAVGDNSDEKNDLEEGLGNTIEENDQMRNVKPSTDEKEKESDGSLNSESKETSNDQIHDDELKGSMETLDEKESDKSANDNKLGTEKSKGEVTQQDEMVGETEEEKIKKNLHSETTQSTGGSNTESHENNPALKEVSITGTPSETLIETSTENGTWSTQAAESQHEKESQKSSVSIDSRTYDWKLCNTTTGSEYIPCLDNWQAIRKLQSIRHYEHRERHCPDEATTCLVSLPEGYRSPIRWPKSREMIWYNNAPHTKLVVDKGHQNWVKVTGKYLTFPGGGTQFKHGALHYIEFIQKSLPKIAWGKRSRVILDVGCGVASFGGYLFEKDVLTMSFAPKDVHEAQVQFALERGIPATLGVMGTVRLPYPGSVFDLVHCARCRVPWHIEGGKLLLELNRVLRPGGHFVWSATPVYQKDPEDVEIWKAMGEITKSMCWDLVVIAKDKLNGVAAAIYRKPTDNECYNNRIKHEPPMCSESDDPNTAWNVSLQACMHKVPVDASERGSIWPEQWPLRLEKPPYWIDSQAGVYGRAASVEFTADYKHWKNVISHSYLNGMGINWSSVRNVMDMKAVYGGFAAALRALKVNVWVMNVVPIDSPDTLPIIYERGLFGIYHDWCESLNTYPRSYDLLHADSIFSTLKEKCNILAVIAEVDRILRPEGYLVIRDNVETIGEIESMAKSLHWDIQLTYSKNGEGFLCIQKTFWRPTKVETVASAIA

SEQ ID NO: 457 - DNA, 2433 bp, Glycine max
  Glyma06g12540.1
atggcgctggggaagaattcccaaggcaaggggaggaagttgtcaaactactgttcaaccgtctctgtggctgtgtttgttgcattttgtttagttggtgtatggattgtattgtcatccattgttccaattcagaattcagtcattcaggtatctgagactgagacaattaatgatgatgttaaaaatgtagcaagtgattccaagcaatttgaagacagatctgaaaaccaggatgaccaaaagggaattgaaaaagtgtctgataatactgcagaagaaaaccaggaggttgttggggacaactcagatgaaaagaatgatttggagaagggtctggagaatactattgaggagaatgatcaaatgaggaatgtcaagccgagcactgacgagacggagaaagaatcagatagaagcttaaattcagaatctgaagaaacagaaacttcgaatgatcaaattcatgacgatgaacttagaggatcaatggaaactttagatgaaaaagaatctgacaagagcacaaatgataacaaattagggacagaaaagagtatggatgaagccacacaacaagatgagatggttggcgagactgcggaggacaaaaaacatctgcattcagaggcaacacaaagtactggagggagtaacacagaaagccatgaaaacaatccagcttctaaagaaattttagttactggtacctcatcagaaattttgatcgaaactagcactgaaaatggaacatggtcaactcaagctgcagagtcacagcatgagaaggaatcacagaagtctttggtttctattgacagcagaacatatgactggaaactttgtaatacaactacaggatcagagtacattccttgccttgacaattggaaagcaattagaaagcttcagagcataagccactatgaacatcgtgagaggcactgtcctgatgaagctaccacttgtcttgtttctctgcctgagggttatagaagcccaattaggtggcccaaaagcagggaaatgatatggtacaaaaatgctccacatacaaaactcgttgtagataagggtcatcaaaactgggtcaaagttactggtgaataccttacttttcctggtggtggaacacagtttaaacatggcgctcttaattacattgaattcattcagaaatctcttcccaaaattgcatgggggaagagaagtcgtgtgatattggatgttgggtgtggggtagccagctttggaggctatctgtttgaaaaagacgttctgaccatgtcatttgctccaaaagatgtacacgaggcacaagtgcaatttgcactggaacggggaattcctgccacattaggtgtcatgggcactgtaagattaccctaccccggttctgtctttgatcttctccactgtgctcgttgtagagtcccttggcacgtagaaggtggcaagctgctcttggagcttaatcgtgtattacgccctggaggttactttgtatggtctgctactccagtgtaccaaaaggatccagaagatgttgagatttggaaagcaatgggtgaaattacaaagtcaatgtgttgggatctggtggtaattgcaaaggacaaattgaatggagtggcagcagcaatatatagaaaaccaactgacaatgaatgctataacaacagaataaaaaatgagccatcaatgtgcagcgaatctgatgatccaaatacagcttggaatgtatcactacaggcttgtatgcacaaagtgcccgtagatgcatcagagcgtggatcaatctggcctgagcaatggccactgaggttggagaaaccaccttactggatagactctcaggctggtgtttatggaagagctgcttcagtggaattcactgctgattacaagcattggaaaaacgttatttcccacttgtatttgaatggaatgggtatcaattggtcttcagtaagaaatgtcatggacatgaaagctgtttatggagggtttgctgcggcactcagagccctgaaattgaatgtttgggtaatgaatgtggttccaattgattctccggacacactgccaataatatatgagcgtggattattcggtatttatcatgattggtgtgaatcattcaatacttaccctagatcatatgatctgctccatgctgactctatattctcaacacttaaggaaaagtgcaataaagtagcagtgattgcagaagttgataggatcctgagaccagaaggatatttggtcataagagacaatgttgaaactattggtgagatagagagcttggctaaatctctacaatgggatattaggttgacatattccaaaaatggagaaggattactttgcattcagaagacattctggcgtccaacaaaggttgaaacagttgcatcagccattgca

SEQ ID NO: 458 - protein, 811 aa, Glycine max
  Glyma06g12540.1
MALGKNSQGKGRKLSNYCSTVSVAVFVAFCLVGVWIVLSSIVPIQNSVIQVSETETINDDVKNVASDSKQFEDRSENQDDQKGIEKVSDNTAEENQEVVGDNSDEKNDLEKGLENTIEENDQMRNVKPSTDETEKESDRSLNSESEETETSNDQIHDDELRGSMETLDEKESDKSTNDNKLGTEKSMDEATQQDEMVGETAEDKKHLHSEATQSTGGSNTESHENNPASKEILVTGTSSEILIETSTENGTWSTQAAESQHEKESQKSLVSIDSRTYDWKLCNTTTGSEYIPCLDNWKAIRKLQSISHYEHRERHCPDEATTCLVSLPEGYRSPIRWPKSREMIWYKNAPHTKLVVDKGHQNWVKVTGEYLTFPGGGTQFKHGALNYIEFIQKSLPKIAWGKRSRVILDVGCGVASFGGYLFEKDVLTMSFAPKDVHEAQVQFALERGIPATLGVMGTVRLPYPGSVFDLLHCARCRVPWHVEGGKLLLELNRVLRPGGYFVWSATPVYQKDPEDVEIWKAMGEITKSMCWDLVVIAKDKLNGVAAAIYRKPTDNECYNNRIKNEPSMCSESDDPNTAWNVSLQACMHKVPVDASERGSIWPEQWPLRLEKPPYWIDSQAGVYGRAASVEFTADYKHWKNVISHLYLNGMGINWSSVRNVMDMKAVYGGFAAALRALKLNVWVMNVVPIDSPDTLPIIYERGLFGIYHDWCESFNTYPRSYDLLHADSIFSTLKEKCNKVAVIAEVDRILRPEGYLVIRDNVETIGEIESLAKSLQWDIRLTYSKNGEGLLCIQKTFWRPTKVETVASAIA

SEQ ID NO: 459 - DNA, 1662 bp, Vitis vinifera
  GSVIVT01008776001
atggtagagtcaaagaatgagaaggaatcactagaatctacaatatctaagccaaatggttatggttggaaactctgcaatgtcactgctggcccagactacatcccgtgccttgacaatgtgcaaactattagaagacttccaagtacaaagcactatgaacatagagagaggcactgccctgatgaggctcctacctgtcttgttcctttgcctggaggatataaacgtccagttcagtggccaacaagccgggaaaagatctggttcaataatgttccccacacaaagcttgctgtggtcaaaggccatcaaaattgggttaaagttactggtgaataccttacttttcctggtggtggaactcagtttacgcacggtgctcttcattacattgattacatccaaaaaactcttcctgatattgcatgggggaagcaaagccgtgtgatattggatgttgggtgtggtgtggccagctttggaggttatatttttgaaagagatgtgcttgcaatgtcatttgctcccaaggatgagcatgaagctcaagtgcaatttgcacttgaacggggaatccctgctatatcagctgttatgggaaccacgagactgccattccccagtagggtctttgacgttgtccactgtgcacgttgcagggttccttggcatattgaaggtggtaaacttctcttagagctgaaccgtgtcttgcggcctggtggttactttgtgtggtctgctactccagtttaccggaaagttcctgaagatgttggcatttggaacgccatgtctgaaataacaaagaaaatttgctgggatctggtggcaatgagcaaggatagtttgaatggaataggtgcagcaatatacagaaagccaacttccaatgagtgctatgagaaaaggccgcgaaatgagcctccactgtgtgaagaatctgacaatgcagatgcagcctggaatataccccttcaagcatgcatgcataaggtgccggtacttacctcagaacgtgggtctcagtggccagagcaatggccactcagagtggagaaagcgcctaactggttgaagagttctcaggttggagtctacggcaaggctgctccagaggactttacttctgactatgagcactggaaaactgttgtctcctcatcatatttgaaagggatgggaatcaaatggtcttctgttaggaatgtcatggacatgaaagctgtatatgggggatttgctgccgcactgaaagacttgaaagtgtgggtcatgaacgtagtcccaattaactccccagacacactcccaattatctttgaacgggggttatttggaatatatcatgattggtgtgaatcgtttagcacctatcccagatcttatgatcttgttcatgctgatcatctcttctctgatctgaaaaagaggtgccagttaacagcagtaattgcagaagttgataggatcctaaggccagaaggaatgcttatagtacgggacaatgttgagactgtaagtgaggtggagagcatggcaaagtctctacagtgggaggtccggttgacatactcaaaggacaaagaaggtcttctttgtgttaagaagacgttttggcgccccacagagacacagaccatcaaatcggctattgct

SEQ ID NO: 460 - protein, 554 aa, Vitis vinifera
  GSVIVT01008776001
MVESKNEKESLESTISKPNGYGWKLCNVTAGPDYIPCLDNVQTIRRLPSTKHYEHRERHCPDEAPTCLVPLPGGYKRPVQWPTSREKIWFNNVPHTKLAVVKGHQNWVKVTGEYLTFPGGGTQFTHGALHYIDYIQKTLPDIAWGKQSRVILDVGCGVASFGGYIFERDVLAMSFAPKDEHEAQVQFALERGIPAISAVMGTTRLPFPSRVFDVVHCARCRVPWHIEGGKLLLELNRVLRPGGYFVWSATPVYRKVPEDVGIWNAMSEITKKICWDLVAMSKDSLNGIGAAIYRKPTSNECYEKRPRNEPPLCEESDNADAAWNIPLQACMHKVPVLTSERGSQWPEQWPLRVEKAPNWLKSSQVGVYGKAAPEDFTSDYEHWKTVVSSSYLKGMGIKWSSVRNVMDMKAVYGGFAAALKDLKVWVMNVVPINSPDTLPIIFERGLFGIYHDWCESFSTYPRSYDLVHADHLFSDLKKRCQLTAVIAEVDRILRPEGMLIVRDNVETVSEVESMAKSLQWEVRLTYSKDKEGLLCVKKTFWRPTETQTIKSAIA

SEQ ID NO: 461 - DNA, 2304 bp, Solanum lycopersicum
  Solyc04g063230.2.1
atggctggggaaagttactcccattctggtgggagaaaatcatctgatttctgttcaaaactcactgttgtgacttttctcggaatttcttgcattgggatatggatgttgatatcatcatcattcagtataactcttcaaaattcagagatatcttccacgaatattttggggcagtattcaggcagttctgctgattttctagtcaatacaaagagaggagaagatgaaacattccagggagagaaacggttcagaaggggaaggtatttggaggagattggagatgaaaaggggctggatagttaccaaaatgaggaaagggaaggagaaagctctaatttaagaaatgaagaagaaaatcaagaaaattctgaatccagtccatccggtgatgaatctcagtctggcgatgagagttcaaatcgagagagtgaggaagtagattcgagagagaaagactcaacttcaggcgatggtgagtcagatactggaggtgaagactcaaatttagatgcttctgagacaacagagaaagcaaagaaaggagagacggagaatgaagtttttccagctgctgatcaatcagagattttgaaggaagctacaacacaaaatgggccatggtcaactcaggctgctgagtctgaaaaggagaatgagtcacagggttcttcatcatcaacggatgacaagaaaggcgataagtggaagctatgcaaaactgatgctggaccagattatattccctgtctagataatgtgcaagctataaggaagctccaacacactagccactatgagcatcgtgaaaggcattgccctgttgaagcttcaacttgcctggttcctctgccttcaggatacaagaagtcaattggatggcctaggagcagggatcagatatggtactctaatgttcctcatggaaagctagccgaggtcaaggggcaccagaactgggtcaaagtaactggagagtaccttactttccccggtggaggtactcagtttaagcaaggtgctcttcattacattgatttcctccaaaagaccctgcctcaaatttcatggggcaaacaaacacgtgttattttggatgttggttgtggagtggccagctttggaggatatctctttgaaagagatgtactagcaatgtcacttgcccccaaggatgagcacgaagcccaagtgcaatttgcacttgaaaggggtattcctgctatatcagctgttatgggaactaaaagactacctttccctggcaaagtgtttgatgctgtccattgtgcacggtgtagagttccatggcatattgaaggtggcaaacttctcctagaattgaatcgtgtcttgcggcctggtggtcacttcatttggtctgcaacaccagtatatcggaaggatgaggaaaatgttggaatttgggaagctatgtctgaactaactaagtcaatgtgctgggaactattggaaattaatgaagataaactaaatgaagtaggtgtagctatattcagaaagccaactacaaatgattgctaccagagtagaacacaaaatgacccacctatgtgtgaagaagctgatgatccagatgctgcctggaatataacacttcaggcatgtttgcacaaagctccagcagatgcatctgcacgaggagcaaagtggccagcaaaatggcctttgaggtcggagaagcttccttattggttgaaaagttctcaagttggagtttatggaaaagcagccccagaagacttcgctgcagactatgatcattggaaaaatgttgtgtcaaaatcatatttaaatgatcttggcattaattggtcttcagtaaggaatgtcatggacatgaaagctatttatggaggatttgctgcagcactgaaagacttgaaagtctgggttatgaatgtagttccgattgactcacctgacacacttccaattatatatgaccgtggcttgtttggcatttaccacgactggtgtgagtccttcagcacatacccaagatcctatgatcttcttcatgcagatcatctattctccgatattaagaaaaggtgcacgatagaatcagtatttgcagaagttgacaggattctgaggccagaaggtaagttgatcgtgcgggacaatgctgaaactattcttgaaatagagaatatggctaggtcagtaaaatggaaagtgaagatgtcttactcaaagaatggtgaaggattactatttgttcaaaaatcattttggcgtccaaatcaagaacagatagtcaagtcagccattgca

SEQ ID NO: 462 - protein, 768 aa, Solanum lycopersicum
  Solyc04g063230.2.1
MAGESYSHSGGRKSSDFCSKLTVVTFLGISCIGIWMLISSSFSITLQNSEISSTNILGQYSGSSADFLVNTKRGEDETFQGEKRFRRGRYLEEIGDEKGLDSYQNEEREGESSNLRNEEENQENSESSPSGDESQSGDESSNRESEEVDSREKDSTSGDGESDTGGEDSNLDASETTEKAKKGETENEVFPAADQSEILKEATTQNGPWSTQAAESEKENESQGSSSSTDDKKGDKWKLCKTDAGPDYIPCLDNVQAIRKLQHTSHYEHRERHCPVEASTCLVPLPSGYKKSIGWPRSRDQIWYSNVPHGKLAEVKGHQNWVKVTGEYLTFPGGGTQFKQGALHYIDFLQKTLPQISWGKQTRVILDVGCGVASFGGYLFERDVLAMSLAPKDEHEAQVQFALERGIPAISAVMGTKRLPFPGKVFDAVHCARCRVPWHIEGGKLLLELNRVLRPGGHFIWSATPVYRKDEENVGIWEAMSELTKSMCWELLEINEDKLNEVGVAIFRKPTTNDCYQSRTQNDPPMCEEADDPDAAWNITLQACLHKAPADASARGAKWPAKWPLRSEKLPYWLKSSQVGVYGKAAPEDFAADYDHWKNVVSKSYLNDLGINWSSVRNVMDMKAIYGGFAAALKDLKVWVMNVVPIDSPDTLPIIYDRGLFGIYHDWCESFSTYPRSYDLLHADHLFSDIKKRCTIESVFAEVDRILRPEGKLIVRDNAETILEIENMARSVKWKVKMSYSKNGEGLLFVQKSFWRPNQEQIVKSAIA

SEQ ID NO: 463 - DNA, 2487 bp, Arabidopsis thaliana
  AT5G64030.1
atggcgcaaccaaggtacactaggatagataacaggaggccctcatcaaattattgctctacagtgacagtagttgtgtttgtggccctatgcttagtcgggatctggatgatgacatcatcttctgttggaccggctcagaatgttgatgaggtttctctggacaacaaagatgggataaagaaacagatgaccccacctgcagaggagggtaatggtcagaagtttgaagacgcacctgttgaaacaccgaacgaggataaaaaaggagatggtgatgcaagcttgcccaaagaggatgagagctcaagcaaacaagataaccaggaagagaagaaagaagagaaaactaaagaagagtttactccatccagtgagacgaaaagtgagaccgaaggtggggaagatcaaaaagatgactccaagtcagaaaatggtggtggaggtgatttagatgagaaaaaagatttgaaagacaactcagatgaagaaaatcctgacacaaatgaaaagcaaactaaaccagaaacagaggacaatgagttgggtgaggatggtgaaaaccaaaagcaatttgagtctgataacggtgagaaaaaatccattgatgatgataaaaaatccagtgatgatgataaagaaaacaagacaggcaacgaagatactgaaaccaagactgagaaggaaaacactgagacaaatgtggatgttcaagtagagcaagagggtcaatccaaaaacgagacctcaggtgatctttcacctcctggggcacaattagagctactgaatgaaactaccgcacagaatggttcattttcaacccaggcaacagagtccaaaaatgagaaagaagctcagaagggttctggtgataaacttgattacaaatgggcactatgcaatacaacagcaggacctgattacattccctgtctcgataatgtgcaagccattaggagtcttccgagtactaaacattacgagcatcgtgagaggcattgcccagacagcccacccacctgccttgttcctttgcctgatggatacaagcggccaattgagtggcccaaaagtcgagaaaagatctggtacaccaacgtccctcataccaagcttgctgagtataaggggcatcaaaattgggttaaagttaccggtgagtatctaacttttcctggtggaggaacccaattcaagcatggtgctcttcattacatcgatttcatacaggagtctgtccctgctattgcatggggtaaacgctctcgtgtggtcctggatgttggatgcggtgttgcaagctttggaggtttcctctttgacagagatgtgatcactatgtctcttgcacctaaagatgaacatgaagctcaggtgcaatttgctcttgagaggggcattcccgccatttctgcagttatgggcacgacaaggctacctttccctggcagagtttttgacatagttcattgtgctcgctgtagagtgccatggcacattgaaggtggtaaacttctcctggagcttaaccgtgtattgagacccggtgggttctttgtgtggtctgctactcctgtttatcagaagaagaccgaagatgttgaaatttggaaagctatgagtgaactcattaagaagatgtgttgggaactcgtatccattaacaaggacactatcaatggagtaggtgttgctacttacagaaagccaacttcaaatgagtgctacaaaaacagatcagaaccggtgcctccaatttgtgcagactctgatgatccaaatgcatcttggaaagtgccgcttcaagcatgcatgcacaccgcgccagaagacaaaacgcaacgtggatctcagtggcccgaacaatggccagcgagattagagaaagcaccgttctggttatcaagttcccagactggagtttacggaaaagcagcaccagaggatttcagtgctgattatgagcactggaaacgcgtagtgaccaaatcataccttaatggtttaggaatcaactgggcatctgttagaaatgtgatggacatgagagccgtttatggaggttttgcggcagctctaagagatctgaaagtgtgggtcatgaatgtggttccaatagattcaccagacacacttgcaataatctatgaacgaggactctttggtatctaccacgattggtgcgaatctttcagtacatacccgagatcatatgatctccttcacgccgaccatcttttctccaaactcaaacaaaggtgcaatctaactgcggtgatagcagaagtggatcgtgttttgagaccggaagggaaactgatagttcgagacgatgcggaaacaatacagcaagtggaaggcatggtgaaagcgatgaaatgggaagttcgaatgacttattctaaggaaaaagaaggtttgctctctgttcaaaaatcaatctggcgacccagtgaagtggaaacactcacttacgctatcggt

SEQ ID NO: 464 - protein, 829 aa, Arabidopsis thaliana
  AT5G64030.1
MAQPRYTRIDNRRPSSNYCSTVTVVVFVALCLVGIWMMTSSSVGPAQNVDEVSLDNKDGIKKQMTPPAEEGNGQKFEDAPVETPNEDKKGDGDASLPKEDESSSKQDNQEEKKEEKTKEEFTPSSETKSETEGGEDQKDDSKSENGGGGDLDEKKDLKDNSDEENPDTNEKQTKPETEDNELGEDGENQKQFESDNGEKKSIDDDKKSSDDDKENKTGNEDTETKTEKENTETNVDVQVEQEGQSKNETSGDLSPPGAQLELLNETTAQNGSFSTQATESKNEKEAQKGSGDKLDYKWALCNTTAGPDYIPCLDNVQAIRSLPSTKHYEHRERHCPDSPPTCLVPLPDGYKRPIEWPKSREKIWYTNVPHTKLAEYKGHQNWVKVTGEYLTFPGGGTQFKHGALHYIDFIQESVPAIAWGKRSRVVLDVGCGVASFGGFLFDRDVITMSLAPKDEHEAQVQFALERGIPAISAVMGTTRLPFPGRVFDIVHCARCRVPWHIEGGKLLLELNRVLRPGGFFVWSATPVYQKKTEDVEIWKAMSELIKKMCWELVSINKDTINGVGVATYRKPTSNECYKNRSEPVPPICADSDDPNASWKVPLQACMHTAPEDKTQRGSQWPEQWPARLEKAPFWLSSSQTGVYGKAAPEDFSADYEHWKRVVTKSYLNGLGINWASVRNVMDMRAVYGGFAAALRDLKVWVMNVVPIDSPDTLAIIYERGLFGIYHDWCESFSTYPRSYDLLHADHLFSKLKQRCNLTAVIAEVDRVLRPEGKLIVRDDAETIQQVEGMVKAMKWEVRMTYSKEKEGLLSVQKSIWRPSEVETLTYAIG

SEQ ID NO: 465 - DNA, 2442 bp, Eucalyptus grandis
  Eucgr.I00186.1
atggctttaggaaaatatactagagtcgataatagaaggtcctcgtcaagttactgctctacggtgacaatagcagtttttgttgccctctgcttggttggagtatggatgatgacatcgtcgtcagttgttcccgtgcaaaatgtagacgtatcccaggagaccaagagtgaggtgaaggagcaagtggttgagaacaataatgaggtgaaggaacaagcatatgagaatgtggatgaagtaaaggaacaagagaaaaaagatagcaacaccagccaatttgaggataatccaggtgacttacccgaggatgccaccaaaggagacaccaatgatacgccttctcagagtgaaagtgactcgaattcgcaagagaaccaagaacagaagcaagatgagaacgtggaacagaaaactggcgaaaaggaaagttcagtggaggagaccaagtccgaagataatgaatcagatcaagaaacagatagatcaaaaactgatggtggagataatgattctggtgaacagaaatctgatacagatgagagggagaagaaaacggattccgaagaaaattcagctgataataagagtgaagagaaagtggatggtgagattgaggagaaggtgaaccaagatgataatgatggatctggggatagctcgaatgacaagaaggatgagagtcagacaaaggatcagagtccttctgaagtgttcccttctggtgctcaatcagaacttttgaatgaaactacaactcagaatggggcattttctacacaagctgctgaatcgaagaatgagaaggaatctcaaggttcatccaagcagcaaactagctacagctggaaaatgtgtaatgttactgctggttctgattatattccctgccttgataatttgcaagctattaagaggcttagctctaccaagcattacgaacaccgagagaggcactgccccgagaatccacctacttgcctcgttgctcttcctaaaggatacagaaagccaattgagtggcctacaagtagagaaaagatatggtactataatgttccacacaccaagctcgctgaagttaagggccaccagaactgggtgaaagttagtggtgaataccttaccttccctggtggcggaacccaatttaaacatggtgctctgcattacatcgatttcatccaggagtctgttcctgatgttgcctggggaaaacgctctcgtgtgatattggatgtgggatgtggtgttgctagttttggaggctatctctttgatagagatgttcttgcaatgtcacttgccccgaaagatgaacatgaagcacaggttcaattcgcacttgagaggggaatccctgctatatctgctgtcatgggcaccacgagacttcccttccctagccgagtctttgatattgtacattgtgcacgctgtagagtcccgtggcatatagaaggtggtaaactcctcttggagctgaaccgcctcttgcgacctggtggtttctttgtgtggtcagctactccagtttatcagaagattccagatgatgttgccatttggaaagccatgtctgcactactaaagtcaatgtgctgggagctgatatctataaataaggatactttgaatggggttggtgtagcaacctacaggaagcctatgtctaatgaatgctatgagaaaagatcccaaaatgatcccccaatgtgtgcagactctgatgattcaaatgctgcctggtatgtgcctctgcaaacatgcatgcataaaatacctatagactctgcggaacgtgggtctcaatggccagaggaatggccagcgaggttggtcaaaacaccttattggctgttgagttcccaggttggagtctatggtaaatctgcccccgaggatttcgctttagacaataagcactggaaacgggttgtgaccaagtcatatttaagtggaattgggattgactggtcaactgttaggagtgtcatggacatgcgagcaatttatggagggtttgctgctgctttaaaagatttgaatgtgtgggtcatgaatgtggtatccgtcgatgccccggataccttacccataatctatgaacgaggtctatttggcatttatcatgactggtgtgaatcttttagcacctaccccagatcttatgatcttctccattcggaccatctcttctccaagatcaaaaagaggtgcaacttagtagctctagtagcagaggtggatcgtatcttgagacctgggggcaagttgatcatcagggatgatgtcgagacaatcaatgaggtggagagcatggtgcgggcgatgcaatgggaagtccggctgacgtactccaaggacaacgagggtttgctttgtgtccagaagtccatgtggcgccccagcaaatcggagacagtcagctacgccattgct

SEQ ID NO: 466 - protein, 814 aa, Eucalyptus grandis
  Eucgr.I00186.1
MALGKYTRVDNRRSSSSYCSTVTIAVFVALCLVGVWMMTSSSVVPVQNVDVSQETKSEVKEQVVENNNEVKEQAYENVDEVKEQEKKDSNTSQFEDNPGDLPEDATKGDTNDTPSQSESDSNSQENQEQKQDENVEQKTGEKESSVEETKSEDNESDQETDRSKTDGGDNDSGEQKSDTDEREKKTDSEENSADNKSEEKVDGEIEEKVNQDDNDGSGDSSNDKKDESQTKDQSPSEVFPSGAQSELLNETTTQNGAFSTQAAESKNEKESQGSSKQQTSYSWKMCNVTAGSDYIPCLDNLQAIKRLSSTKHYEHRERHCPENPPTCLVALPKGYRKPIEWPTSREKIWYYNVPHTKLAEVKGHQNWVKVSGEYLTFPGGGTQFKHGALHYIDFIQESVPDVAWGKRSRVILDVGCGVASFGGYLFDRDVLAMSLAPKDEHEAQVQFALERGIPAISAVMGTTRLPFPSRVFDIVHCARCRVPWHIEGGKLLLELNRLLRPGGFFVWSATPVYQKIPDDVAIWKAMSALLKSMCWELISINKDTLNGVGVATYRKPMSNECYEKRSQNDPPMCADSDDSNAAWYVPLQTCMHKIPIDSAERGSQWPEEWPARLVKTPYWLLSSQVGVYGKSAPEDFALDNKHWKRVVTKSYLSGIGIDWSTVRSVMDMRAIYGGFAAALKDLNVWVMNVVSVDAPDTLPIIYERGLFGIYHDWCESFSTYPRSYDLLHSDHLFSKIKKRCNLVALVAEVDRILRPGGKLIIRDDVETINEVESMVRAMQWEVRLTYSKDNEGLLCVQKSMWRPSKSETVSYAIA

SEQ ID NO: 467 - DNA, 2382 bp, Glycine max
  Glyma04g38870.1
atggctttggggaaatatgctagagtagatggtagaagatcgtcgagttggtgttcaacggtgactgttgtcatgtttgtggctctgtgcttggttggggtttggatgatgacatcatcttcagttgttcctgtgcgtaacggagacgaagcccaggagaataagaaccaagtgaaagaacaagcagaggtgaaagaagcagtgagtgaggtcagcaatagcaatacgcggcagtttgaagataatccaggtgatttgcctgaggatgcaaccaagggggacagcaatgtaacctttgaagacaactcaaactcttcagataaacaagagaagttggaggaaaatcctgtagagaggtcttctgatgatacaaagacagaagacgtggatgataagaaaactgaggaggaaggttctaatacagaaaacgaatcaaactcagactctgtggaaaataacaaagacagtgatgagacttccactaaggaatctgattctgatgagagtgagaagaagcctgattctgatgataacaagaagtctgattcagatgaaagtgaaaagcaatctgatgactctgatgaaacaacaaatactaggatagaggagaagaatacaaatgatgataccaaacagaagacttcaaaggaggtatatccttctggggctcagtctgagcttcacgaagaaagtactacagaaactgggtcttggtcaactcaggcagcagagtctaagaatgaaaaggagtctcaagaatcctccaagcaggcaactggatacaagtggaagctttgcaatgtcactgctggtcctgattttatcccatgccttgacaactggaaagctattaggagtctccggagtactaaacactatgaacatcgagaaagacactgtcctgaagaacctcctacctgccttgttcctgttcctgaaggatataaacgcccaattgagtggcctaaaagcagagagaagatatggtattacaatgttccacacacaaagcttgctaaagttaagggccaccagaattgggtgaaagttacgggcgagtaccttacttttcctggtggtggaacccaattcaaacatggggcacttcattacattgactttatacaagagactgaacctgacattgcttggggcaaacgcacgcgcgttatactagatgttggatgtggtgttgccagctttggaggttttctctttgatagagatgtacttgcaatgtcattagcaccaaaggatgaacatgaagctcaggtacaatttgcacttgaaagggggattcctgctatatctgctgtgatgggcacaaagaggcttcccttccctgggaaagtatttgatgtagtccactgtgcacgatgtagagttccgtggcatatagaaggtggtaaacttcttttggagctaaatagagtattgagacctggaggtttttttgtatggtctgctactccaatttatcagaagcttcctgaagatgttgaaatatggaaggccatgaagacactaacaaaagccatgtgctgggaagttgtgtcgatcagcaaggatcaagtaaatggagtaggtgtagctgtatacaagaagccaacttctaatgagtgttacgagcaacgttcaaagaatgagccaccgctgtgtccagactctgatgatcctaatgcagcatggaacattaaattgcaagcttgcatgcacaaagtgccagctagttcaaaggaacgaggctcaaaattgcctgagctgtggccagccagactgaccaaagtgccttattggttgttgagttcccaagttggagtttatggaaagccagcccctgaagatttcactgctgattatgaacactggaaacgtgtagtgtcccagtcttatctagatgggatgggaattaaatggtcaaatgtgcgcaatgtcatggatatgaggtctatctatggaggatttgctgcagctttgagagatttgaatgtttgggtcatgaatgtggttacaatagactcccctgatactcttcccattatttttgaacgaggtctgttcggtatatatcatgattggtgtgaatcatttagcacctatcctaggacctatgatctcctccatgctgatcatctgttttcaaagcttaagaaaaggtgcaatttggcagctgtagtggccgaggctgatcggattcttaggcctgaaggaaaacttattgttcgtgacactgtggagatcgttgaagagcttgagagcatggctaggtctatgcaatggaaggttcgcatgacttactccaaggataaggagggcttgttatgtgtggagaagtccaagtggcgacctaaggagcaggaaaagctcgagtatgctattgtt

SEQ ID NO: 468 - protein, 794 aa, Glycine max
  Glyma04g38870.1
MALGKYARVDGRRSSSWCSTVTVVMFVALCLVGVWMMTSSSVVPVRNGDEAQENKNQVKEQAEVKEAVSEVSNSNTRQFEDNPGDLPEDATKGDSNVTFEDNSNSSDKQEKLEENPVERSSDDTKTEDVDDKKTEEEGSNTENESNSDSVENNKDSDETSTKESDSDESEKKPDSDDNKKSDSDESEKQSDDSDETTNTRIEEKNTNDDTKQKTSKEVYPSGAQSELHEESTTETGSWSTQAAESKNEKESQESSKQATGYKWKLCNVTAGPDFIPCLDNWKAIRSLRSTKHYEHRERHCPEEPPTCLVPVPEGYKRPIEWPKSREKIWYYNVPHTKLAKVKGHQNWVKVTGEYLTFPGGGTQFKHGALHYIDFIQETEPDIAWGKRTRVILDVGCGVASFGGFLFDRDVLAMSLAPKDEHEAQVQFALERGIPAISAVMGTKRLPFPGKVFDVVHCARCRVPWHIEGGKLLLELNRVLRPGGFFVWSATPIYQKLPEDVEIWKAMKTLTKAMCWEVVSISKDQVNGVGVAVYKKPTSNECYEQRSKNEPPLCPDSDDPNAAWNIKLQACMHKVPASSKERGSKLPELWPARLTKVPYWLLSSQVGVYGKPAPEDFTADYEHWKRVVSQSYLDGMGIKWSNVRNVMDMRSIYGGFAAALRDLNVWVMNVVTIDSPDTLPIIFERGLFGIYHDWCESFSTYPRTYDLLHADHLFSKLKKRCNLAAVVAEADRILRPEGKLIVRDTVEIVEELESMARSMQWKVRMTYSKDKEGLLCVEKSKWRPKEQEKLEYAIV

SEQ ID NO: 469 - DNA, 2418 bp, Glycine max
  Glyma06g16050.1
atggctttggggaaatatgctagggtagatggtagaagatcgtcgagctggtgttcgacggtgactgttgtcgtgtttgtggctctatgcttggttggggtttggatgatgacatcatcttcagttgtccctgtgcgtaatggagatgaggcccaggagaataagaaccaagtgaaagaacaaacagagcctacagaggtgaaagaagcagtgagtgaggtcagcaatagcaatatgcggcagtttgaagataatccaggtgatttgcctgaggatgcaaccaaaggggacagcaatgtagcctctgaagacaactcaaacttgtcagataaacaagaagagaagtcggaggaaaatcctgtagagaggtcttctgacgatacaaagtcggaagacgtggaggataagaaaactgaggaggaaggttctaatacagaaaatgaatcaaactcagactctacagaaaatagcaaagacagtgatgagacttccactaaagaatctgattctgatgagaatgagaagaagtctgattcagatgaaagtgaaaagcaatctaatgacactgatgaaacaacagatactaagatagaggagaaggtggaagaaagtgataacaaggaatctgatgaaaactctagtgagaagaatataaatgatgataccaaacagaagagttcaaaggaggtatacccttctggggctcagtctgagcttcaagaagaaagtacagcagaaactgggtcttggtcaactcaggcagcacagtcgaagaatgaaaaggattctcaagagtcctccaagcagccaactggatacaagtggaagctttgtaatgtcactgctggtcctgattttataccatgccttgataactggaaagctattaggagtctccagagtactaaacactatgaacatcgagaaaggcactgtcctgaagaacctcctacctgccttgttcctgttcctgaaggttataaacgcccaattgagtggcctaagagcagagagaagatatggtattacaatgttccacacaccaagcttgctgaagttaagggccaccagaattgggtgaaagtaacgggcgagtaccttacttttcctggtggtggaacccaattcaaacatggggcacttcattacattgactttatacaagagactgtacctgacattgcttggggaaaacgcacacgtgttatactagatgttggatgtggtgttgccagctttggaggttttctctttgatagagatgtacttgcaatgtcgttagcaccaaaggatgaacatgaagctcaggtacaatttgcacttgaaagggggattcctgctatatctgctgtgatgggcacaaagaggcttcccttccctgggaaagtatttgatgtagtccattgtgcacgatgtagagttccgtggcatatagaaggtggtaaacttcttttggagctaaatagagtattgagacctggaggtttttttgtatggtctgctactccaatttatcagaagcttcctgaagatgttgaaatatggaaggccatgaaggcactaacaaaagccatgtgctgggaagttgtgtcgatcagcaaggatccagtaaatggagtaggtgtagctgtatacaggaagccaacttctaatgagtgttacgagcaacgctcaaagaatgagccaccgctgtgtccagactctgatgatcctaatgcagcatggaacattcaattgcaagcttgcttgcacaaagcgccagttagttcaaaggaacgaggctcaaaattgcctgagctgtggccagccagactgatcaaagtgccttattggttgtcgagttcccaagttggagtttatggaaagccagcccctcaagatttcactgctgattatgaacactggaaacgtgtagtatccaagtcttatctagacgggatgggaattaaatggtcaaatgtacgcaatgtcatggatatgagatctatctatggaggatttgctgcagctttgagagatttgaatgtttgggtcatgaatgtggttacaatagactccccagatactcttcctattatttatgaacgaggtctttttggtatatatcatgattggtgtgaatcatttagcacctatcctaggacctatgatctcctccatgctgatcatttgttttcaaagcttaagaaaaggtgcaatttggctgctgtagtggctgaggctgatcggattcttaggcctgaaggaaaacttattgttcgcgatactgttgagatcattgaagagcttgagagcatggctaggtctatgcagtggaaggttcgcatgacttactccaaggataaggagggtttgttatgtgtggagaagtccaagtggcgacctaaggagcaggaaaagctcgagtatgctattgct

SEQ ID NO: 470 - protein, 806 aa, Glycine max
  Glyma06g16050.1
MALGKYARVDGRRSSSWCSTVTVVVFVALCLVGVWMMTSSSVVPVRNGDEAQENKNQVKEQTEPTEVKEAVSEVSNSNMRQFEDNPGDLPEDATKGDSNVASEDNSNLSDKQEEKSEENPVERSSDDTKSEDVEDKKTEEEGSNTENESNSDSTENSKDSDETSTKESDSDENEKKSDSDESEKQSNDTDETTDTKIEEKVEESDNKESDENSSEKNINDDTKQKSSKEVYPSGAQSELQEESTAETGSWSTQAAQSKNEKDSQESSKQPTGYKWKLCNVTAGPDFIPCLDNWKAIRSLQSTKHYEHRERHCPEEPPTCLVPVPEGYKRPIEWPKSREKIWYYNVPHTKLAEVKGHQNWVKVTGEYLTFPGGGTQFKHGALHYIDFIQETVPDIAWGKRTRVILDVGCGVASFGGFLFDRDVLAMSLAPKDEHEAQVQFALERGIPAISAVMGTKRLPFPGKVFDVVHCARCRVPWHIEGGKLLLELNRVLRPGGFFVWSATPIYQKLPEDVEIWKAMKALTKAMCWEVVSISKDPVNGVGVAVYRKPTSNECYEQRSKNEPPLCPDSDDPNAAWNIQLQACLHKAPVSSKERGSKLPELWPARLIKVPYWLSSSQVGVYGKPAPQDFTADYEHWKRVVSKSYLDGMGIKWSNVRNVMDMRSIYGGFAAALRDLNVWVMNVVTIDSPDTLPIIYERGLFGIYHDWCESFSTYPRTYDLLHADHLFSKLKKRCNLAAVVAEADRILRPEGKLIVRDTVEIIEELESMARSMQWKVRMTYSKDKEGLLCVEKSKWRPKEQEKLEYAIA

SEQ ID NO: 471 - DNA, 2493 bp, Glycine max
  Glyma05g32670.1
atggctcaagccaaatatactagaatagacaataacaagcgaccgtcaagttactgttcaacagtgactattgtcgtgtttgtagctctttgcttgtttgggatttggatgatgacatcgtcatctgttacacccgtgcaaaatgtagatgtgtctcaggagaataatagtgaggtgaaggaacaggcaactgacccctctaataacaattctcagcagtttgaagataatcggggtgatctgtccgaggatgcaaccaaaggggatggtagtgtcacccctgataaaaactctgacgtgaaagaaaaacaggaggagaaatcggacgaaaagtctcaagaaaaaccttctgaagatacaaaaacagaaaatcaagatacaagtgtgagcgagaagagatctgattctgatgagagccagcagaaatctgattctgatgagagccagcagaaatctgattctgatgagagcgagaagaaatctgattctgctgagagtgagaagaaatctgattctgatgagagtgagaagaaatctgattctgatgagactgaaaagagttctgaatcaaatgataacaagcaatttgactcagatgaaagggagaataaatctgattcagatgaaaatgaaaagaagtctggtgatgcaagtgaaacaacagataagactgaagaaaaagtggaacaaagtggtaaccaagagtctgatgaaaactccaatgagaagaaaacagatgacaatgccaacagtcagggttcaaatgaggtttacccttccgtggctcagtcagagcttctgaatgaaagtaccactcaaaatggttcttttacaactcaggcggcagagtcaaagaatgaaaaggagtctcaagtatcctccaagcaatctactatttggaaactgtgtaatgtcactgctggccctgattacatcccatgcctcgacaacttgaaagcaattaggagtcttccaagtaccaaacactatgaacacagagaaaggcaatgtcctgaagaacctcctacctgccttgtccctcttcctgaaggatacaaacgcccaattgaatggcccaaaagcagagagaagatatggtattctaatgttccacacactaagcttgctgaatataaggggcaccagaattgggtgaaagttacaggcgagtaccttacttttccaggtggtggaacccaattcaaacacggtgcacttcattacattgacaccatacaacagtctgtaccagatattgcttggggcaatcgctcacgtgtgattttagatgttggatgtggtgttgccagctttggtggctttctctttgaaagagatgtacttacaatgtcattggcaccaaaagatgaacatgaagctcaggtacagtttgcacttgaaagagggattcctgctatatctgctgtgatgggcacaaagaggcttccctaccctgggagagtatttgatgtagtccattgtgcacggtgtagagttccatggcatatagaaggtggcaaacttcttttggagctgaatagagttttgcgacctggtggtttctttgtatggtctgctactccaatttatcagaagcttcctgaagatgttgaaatatggaatgaaatgaaggcactaacaaaagcaatgtgctgggaagttgtgtctatcagcaaggataaacttaatggagttggtatagctgtgtataagaagccaacttctaatgagtgttatgagaaacgttctcagaatcagcctcctatatgtccagactctgacgatcctaatgcagcatggaacattccattgcaagcttgcatgcacaaagtgcctgtgagttcaacagaacgtgggtcacaatggccagagaagtggccggcaagactgaccaacacaccttactggttgacaaattctcaagttggagtttacggaaagcctgcccctgaagattttactgctgattatgaacactggaaacgtatagtgtccaaatcttatcttaatgggataggaattaattggtctaatgtgcggaatgtcatggatatgagatcagtctatggagggtttgctgctgccttgaaggatttgaatatttgggtcatgaatgtggtttcagtaaattccgcggacacacttcctattatttatgagcgaggtctctttggcatgtatcatgattggtgtgaatcatttagtacctatccgaggtcctatgatctacttcatgcagataatctattttcaaatattaagaacaggtgtaatttaaaagctgtagtggctgagattgatcggattcttaggcctgagggaaagcttattgtccgggacactgttgaaatcattagcgagattgaaagtatggtgaagtccatgaagtgggaggttcgcatgacttactctaaggataaggtgggatttttatgtgtccagaagtccatgtggcggcctaaagaattggagacactcgagtatgctattggt

SEQ ID NO: 472 - protein, 831 aa, Glycine max
  Glyma05g32670.1
MAQAKYTRIDNNKRPSSYCSTVTIVVFVALCLFGIWMMTSSSVTPVQNVDVSQENNSEVKEQATDPSNNNSQQFEDNRGDLSEDATKGDGSVTPDKNSDVKEKQEEKSDEKSQEKPSEDTKTENQDTSVSEKRSDSDESQQKSDSDESQQKSDSDESEKKSDSAESEKKSDSDESEKKSDSDETEKSSESNDNKQFDSDERENKSDSDENEKKSGDASETTDKTEEKVEQSGNQESDENSNEKKTDDNANSQGSNEVYPSVAQSELLNESTTQNGSFTTQAAESKNEKESQVSSKQSTIWKLCNVTAGPDYIPCLDNLKAIRSLPSTKHYEHRERQCPEEPPTCLVPLPEGYKRPIEWPKSREKIWYSNVPHTKLAEYKGHQNWVKVTGEYLTFPGGGTQFKHGALHYIDTIQQSVPDIAWGNRSRVILDVGCGVASFGGFLFERDVLTMSLAPKDEHEAQVQFALERGIPAISAVMGTKRLPYPGRVFDVVHCARCRVPWHIEGGKLLLELNRVLRPGGFFVWSATPIYQKLPEDVEIWNEMKALTKAMCWEVVSISKDKLNGVGIAVYKKPTSNECYEKRSQNQPPICPDSDDPNAAWNIPLQACMHKVPVSSTERGSQWPEKWPARLTNTPYWLTNSQVGVYGKPAPEDFTADYEHWKRIVSKSYLNGIGINWSNVRNVMDMRSVYGGFAAALKDLNIWVMNVVSVNSADTLPIIYERGLFGMYHDWCESFSTYPRSYDLLHADNLFSNIKNRCNLKAVVAEIDRILRPEGKLIVRDTVEIISEIESMVKSMKWEVRMTYSKDKVGFLCVQKSMWRPKELETLEYAIG

SEQ ID NO: 473 - DNA, 2526 bp, Glycine max
  Glyma08g00320.1
atggctcaagccaaatatactagaatagataataataataagcgaccgtcgagttactgttcaacagtgactattgtcgtgtttgtagctctttgcttgtttgggatttggatgatgacatcgtcatctgttacgcccgtgcaaaatgtagatgtgtctcaagagaataacaatgaggtgaaggaacagagtgaggcgaaggaacagccaactgacccctctaataacaattctcagcagtttgaagataatcggggtgatctgtctgaggatgcaaccaaaggggatggtagtgtcacccctgctacaaactatgacgtgacagaaaaacaggacgagaaatcagacgaaaagtctcaagaaaaaccttctgaagatacaaaaacagaaaatcaagattcaagtgtgagcgagaagagatccgattccgacgagagcgagaagagatctgattctgatgagagcgagaaaaagtctgattctgatgagagcgagaaaaagtctgattctgatgagagcgagaagaagtctgattctgatgagagcgagaagaagtctgattctgatgagagcgagaagaagtctgaatataatgagactgaaaagaattctgaatcaaatgactcgagtgaaagggagaataaatctgattcagatgaaaatgaaaagaagtctgatgatgcaagtgaaacaacagataagactgaagaaaaagtggaacaaagtagtaaccaagagtctgatgaaaactccaacgagaagaaaacagatgacaatgccaacagtcagggttcaaatgaggtttacccttccgtggctcagtcagagcttctgaatgaaagtaccactcaaaatggttcttttacaactcaggcagcagagtcaaagaatgaaaaggagtctcaagtatcctccaagcaatctgctaattggaaactgtgtaatgtcactgctggccctgattacatcccatgcctcgacaacttgaaagcaattaagagtcttccaagtaccaaacactatgaacacagagaaaggcaatgtcctaaagaatctcctacctgccttgtccctcttcctgaaggatacaaacgcccgattgaatggcccaaaagcagagagaagatatggtattctaatgttccacacactaagcttgctgaatataaggggcaccagaattgggtgaaagttacaggcgagtaccttacctttccaggtggtggaacccaattcaaacacggtgcacttcattacattgacaccatacaacagtctgtaccagatattgcttggggcaatcgctcacgtgtgattttagatgttgggtgtggtgttgccagctttggtggctttctctttgaaagagatgtacttacaatgtcattggcaccaaaagatgaacatgaagctcaggtacagtttgcacttgaaagagggattcctgctatatctgctgtgatgggcacaaagaggcttccctaccctgggagagtgtttgatgtagtccattgtgcacggtgtagagttccatggcatatagaaggtggcaaacttcttttggagctgaatagagttttgcgacctggtggtttctttgtatggtctgctactccaatttatcagaagcttcctgaagatgttgaaatatggaatgaaatgaaggcactaacaaaagcaatgtgctgggaagttgtgtccatcagcaaggataaactcaatggagttggtatagctgtgtataagaaaccaacttctaatgagtgttatgagaaacgttctcagaatcagcctcctatatgtccagactctgacgatcctaatgcagcatggaacgttccattacaagcttgcatgcacaaagtgccagtgagttcgacagaacgtgggtcacaatggccagagaagtggccagcaagactaaccaacataccttattggttgacaaattctcaagttggagtttatggaaaacctgcccctgaagattttactgctgattatggacactggaaacgtatagtgtccaagtcttatcttaatgggataggaattaattggtccaatatgcggaatgtcatggatatgagatcagtctatggagggtttgctgctgccttgaaggatttgaatatttgggtcatgaatgtggtttcagtaaattccgcagacacacttcctcttatttatgagcgaggtctctttggcatgtatcatgattggtgtgaatcatttagcacctatccgaggtcctatgatctacttcatgcagataatctattttcaaatattaagaacaggtgtagtttaaaagctgtagtggctgagattgatcggattcttaggccagagggaaagcttattgtccgggacactgttgaaatcattaacgagatggaaagtatggtgaagtccatgcagtgggaggttcgcatgacttactctaaagataaggtgggctttttatgtgtccagaagtccatgtggcggcctaaagaattggagacactcgagtatgctattggt

SEQ ID NO: 474 - protein, 842 aa, Glycine max
  Glyma08g00320.1
MAQAKYTRIDNNNKRPSSYCSTVTIVVFVALCLFGIWMMTSSSVTPVQNVDVSQENNNEVKEQSEAKEQPTDPSNNNSQQFEDNRGDLSEDATKGDGSVTPATNYDVTEKQDEKSDEKSQEKPSEDTKTENQDSSVSEKRSDSDESEKRSDSDESEKKSDSDESEKKSDSDESEKKSDSDESEKKSDSDESEKKSEYNETEKNSESNDSSERENKSDSDENEKKSDDASETTDKTEEKVEQSSNQESDENSNEKKTDDNANSQGSNEVYPSVAQSELLNESTTQNGSFTTQAAESKNEKESQVSSKQSANWKLCNVTAGPDYIPCLDNLKAIKSLPSTKHYEHRERQCPKESPTCLVPLPEGYKRPIEWPKSREKIWYSNVPHTKLAEYKGHQNWVKVTGEYLTFPGGGTQFKHGALHYIDTIQQSVPDIAWGNRSRVILDVGCGVASFGGFLFERDVLTMSLAPKDEHEAQVQFALERGIPAISAVMGTKRLPYPGRVFDVVHCARCRVPWHIEGGKLLLELNRVLRPGGFFVWSATPIYQKLPEDVEIWNEMKALTKAMCWEVVSISKDKLNGVGIAVYKKPTSNECYEKRSQNQPPICPDSDDPNAAWNVPLQACMHKVPVSSTERGSQWPEKWPARLTNIPYWLTNSQVGVYGKPAPEDFTADYGHWKRIVSKSYLNGIGINWSNMRNVMDMRSVYGGFAAALKDLNIWVMNVVSVNSADTLPLIYERGLFGMYHDWCESFSTYPRSYDLLHADNLFSNIKNRCSLKAVVAEIDRILRPEGKLIVRDTVEIINEMESMVKSMQWEVRMTYSKDKVGFLCVQKSMWRPKELETLEYAIG

SEQ ID NO: 475 - DNA, 2439 bp, Solanum lycopersicum
  Solyc05g056580.2.1
atggcattaggaaagtactctagagtagatggaaggaagtcatcaaactattgctccactgtaactatagtggtatttgtagctctatgtttagttggggtatggatgatgacgtcatcatctgtcgttccagaccaaaatctagatttgtcctcacaggggaaaaagactgacctgtcaacacaggtaaccgaaggtaaagagagttacaatggtggcaatgagagtaacaataaagctggtgatgagagtaatccaacggatgagggaaaatcaaaacaatttgaggataccctcggtgatttacctgaggatgcaacaaaaggggatgccttagttagtcaagaagaaaatgtttctaatccacaacagacagaatcaacttcagaagtgaaacaggaagagaaatcgacagaacagaaagaggatgctggagaatctgagtcagaaactcaatccgagaaggcaacagatggttcagatgacaaaaaggaagatggtccaaacaaagtagatgacaaggattctgaggctggggagaaaactgaaaataaatctgtcggagaagagatcaaagaaggttctgatgagaaaaaatcaatagaaaactcagttgaactgaatgataaaaaggatcaggaggtaggccaaagttctgatgagaagtctgatggtgagaagaaggacctgtcttcaagtgccgtattgagttcggggactcagtcggaccttttgaatgaaactacaactcaaaatggggcatttttaactcaggcgtcggaatcaaagaatgaaaaggaaatgcagaagtcttcggagtcagataaagaaagtagttacatttggaaactctgcaattccactgctgggccagattatatcccttgccttgataatttggaagcaattaggaacctcagaagtacaaaacattatgaacaccgagagagacactgcccagataatcctccgacttgtcttgttccacttcctgaaggatatcaacattcagttgagtggcctacgagtagggaaaagatatggtaccacaatgttccccatacaaagcttgcagaaattaaaggacatcaaaattgggtaaaagttagtggtgaataccttaccttccctggtgggggaacccagttcaagcatggcgctctgcactatattgatttcatacagcagtcttttccagaaattgcctggggaaagcaaactcgggttatattagatgttggatgtggggttgcaagctttgggggttatcttttcgaaagagatgttttggccatgtctttagctcctaaagatgaacatgaagctcaggttcagtttgctcttgagaggggtattcctgctatatctgctgttatgggtacaaagaggcttccctttcctagtcgagtctttgacgttgttcattgtgcacgttgtagagtgccctggcatattgaaggggggaaacttctcctggagctgaatcgtgtacttcgacctggtggactttttgtgtggtctgctactcctgtctaccagaagctccccgaagatgttgagatctgggaagccatgcagaagttgacaaaggcaatgtgctgggatcttgtttcaaaaaccaaagatagagtcaatggagtaggggttgctgtatatcgcaagcctacttccaatgagtgctatgaacaaagatcaaaagacgctcccccgatttgtcaaggatctgatgatccaaatgcagcctggaatgtgcctttacaagcttgcatgcataaagctcctgttgccacatcggaacgtggatctcaatggccagaaccatggccagccaggttatcgaaatcaccttactggttattgagttcccaggttggagtatatgggaaaccagccccggaagattttactgcagattatgaacactggaaacatgtggtgacaaattcatatcttaatggaatggggataaattggtctactgtgcggaatgttatggacatgcgtgctatctatggaggatttgcagctgctttaagagacttgaatgtgtgggttatgaacgttgtctcagtagatgctccagatacactaccaattatttatgaaagaggtctttttggaatttatcatgactggtgtgaatccttcagcacttaccccagatcgtacgatcttgtccatgcagaccatctcttctccaagattaaaacaaagtgtggtttaccggcaatagttgctgaagttgaccgcattttgagaccaggagggaagctcattgtgcgtgacaaagaggagactataactgagttagaaagtatgctcaagtctatgcaatatgaaatcaatatgacctattccaaggacaaggaaggattgttgtattgccagaaaacaatgtggcgaccaaaggacgttgagacactaacttatgccattgct

SEQ ID NO: 476 - protein, 813 aa, Solanum lycopersicum
  Solyc05g056580.2.1
MALGKYSRVDGRKSSNYCSTVTIVVFVALCLVGVWMMTSSSVVPDQNLDLSSQGKKTDLSTQVTEGKESYNGGNESNNKAGDESNPTDEGKSKQFEDTLGDLPEDATKGDALVSQEENVSNPQQTESTSEVKQEEKSTEQKEDAGESESETQSEKATDGSDDKKEDGPNKVDDKDSEAGEKTENKSVGEEIKEGSDEKKSIENSVELNDKKDQEVGQSSDEKSDGEKKDLSSSAVLSSGTQSDLLNETTTQNGAFLTQASESKNEKEMQKSSESDKESSYIWKLCNSTAGPDYIPCLDNLEAIRNLRSTKHYEHRERHCPDNPPTCLVPLPEGYQHSVEWPTSREKIWYHNVPHTKLAEIKGHQNWVKVSGEYLTFPGGGTQFKHGALHYIDFIQQSFPEIAWGKQTRVILDVGCGVASFGGYLFERDVLAMSLAPKDEHEAQVQFALERGIPAISAVMGTKRLPFPSRVFDVVHCARCRVPWHIEGGKLLLELNRVLRPGGLFVWSATPVYQKLPEDVEIWEAMQKLTKAMCWDLVSKTKDRVNGVGVAVYRKPTSNECYEQRSKDAPPICQGSDDPNAAWNVPLQACMHKAPVATSERGSQWPEPWPARLSKSPYWLLSSQVGVYGKPAPEDFTADYEHWKHVVTNSYLNGMGINWSTVRNVMDMRAIYGGFAAALRDLNVWVMNVVSVDAPDTLPIIYERGLFGIYHDWCESFSTYPRSYDLVHADHLFSKIKTKCGLPAIVAEVDRILRPGGKLIVRDKEETITELESMLKSMQYEINMTYSKDKEGLLYCQKTMWRPKDVETLTYAIA

SEQ ID NO: 477 - DNA, 2388 bp, Populus trichocarpa
  POPTR_0005s06640.1
atggcgttaggcaaatatagtagggtagacaatagaagacataattcgagttactgctcaacagtcacgattgtggtgtttgtgggtctctgcttggttggggcatggatgatgacatcgtcatctgtggttcctggtcaaaatgtagacgttcctgctcaggaaaacaagaatgaggtgaaacaacaagtgactgagagcaatgaaatcaacactaagcaatttgaagataacccagagaagcccgaggagaagccagaagagaagcccgaggagaagccagtagagaaaaccgacgaaaaatctaatgaagagacaaagtcggatgatggttcagataccgagacacaaaatggagtcaacaatacagaagatgtggatgctaaaaccaacgatggagaaacaaacacagaagatggagggacaaaggcagatgatagtgaaggtaatgcagctggacaaggagattccgaggagaattctacagagaagaaacctgatactgatgagaccgaaacaaaatccgatgagaatgctggtgaagataaggatagggaaacagggaatgatcagctagatgagaaggtggatcagaaagatgataaggactccgataaaagttctgatgggcaggccaacaaccagagttcaggcgagctacttccttcaggggctcagtcagagctttcgaatgagacctccactcagagtgggtcgtggtcaactcaggcggcagagtcaaagaatgagaaggaaactcaacagtcttctaaccagcaaaaggggtacaattggaaactgtgcaatgtcactgctgggcctgatttcatcccatgtcttgacaatttgcaagcaatcaggagtcttcaatctacaaagcactatgaacatcgagagaggcactgtcctgaagaacctccaacctgtcttgttctgcttcctgaaggatataaacggccaattgagtggcctacaagcagggaaaagatatggtaccacaatgttccccacacccagcttgcacaatataaggggcatcaaaactgggtgaaagttacaggtgaattcctcactttccctggtggtggaacgcagtttcagcatggggctctccattacatcgacttcttaaatgagtctgtgcctggcattgcatggggaaaacgaacccgtgtgattttggatgttggatgtggagttgctagctttggaggatatcttttcgacagagatgtcctagcaatgtcatttgcccctaaagatgagcatgaagctcaaatacaatttgctcttgaaagaggaatcccagctatatctgccgtgatgggaacaaagaggcttccctacccaggcagagtttttgatgctgtccattgtgcacgctgtagagtaccttggcatattgaaggtggtaaacttcttctggagctgaatcgtgtgttgcgacctggtggtttctttgtgtggtcagccactcctgtttatcagaaactagctgaagatgttgaaatttggcaagccatgactgaactaacaaaagctatgtgctgggaacttgtgtctattaacaaggatacacttaatggagttggtgtagctacgtacaggaagcctacttccaatgactgctatgagaaaagatcaaaacaagagcctccactttgtgaagcatctgatgatcctaatgcagcctggaatgtgccattgcaagcatgtatgcataaggtgcctgtaggttcactggaacgtgggtctcaatggccagagcaatggcccgcaaggttggataaaacaccttattggatgttgagttcccaagtaggagtttatggtaaacccgcaccagaagatttcactgcagattatgagcactggaagcgggtggtctccaattcatatctaaatggaattggattaaactggtcatctgtgagaaatgccatggacatgagatctgtttatggaggttttgctgcagctctgaaggagttgaatgtgtgggtcatgaatgtggtcacagcagattcaccagatactctacctataatttatgaacgtgggctttttggaatttatcatgattggtgtgaatcatttaacacttatccaagatcttatgatcttctccatgcagaccatctcttctccaaggttaaaaagaggtgcaatctggcggctgtatttgctgaagttgatagaattcttaggccagaagggaagctcattgtccgggacaaggtggagatcattaacgagctggagaacatggcaaggtctatgcagtgggaggttaggatgacctactctaaggacaaggaaggattgctgtgtgttcagaaatccatgtggcggcccaaagagtcagagacgatcaattatgctattgct

SEQ ID NO: 478 - protein, 796 aa, Populus trichocarpa
  POPTR_0005s06640.1
MALGKYSRVDNRRHNSSYCSTVTIVVFVGLCLVGAWMMTSSSVVPGQNVDVPAQENKNEVKQQVTESNEINTKQFEDNPEKPEEKPEEKPEEKPVEKTDEKSNEETKSDDGSDTETQNGVNNTEDVDAKTNDGETNTEDGGTKADDSEGNAAGQGDSEENSTEKKPDTDETETKSDENAGEDKDRETGNDQLDEKVDQKDDKDSDKSSDGQANNQSSGELLPSGAQSELSNETSTQSGSWSTQAAESKNEKETQQSSNQQKGYNWKLCNVTAGPDFIPCLDNLQAIRSLQSTKHYEHRERHCPEEPPTCLVLLPEGYKRPIEWPTSREKIWYHNVPHTQLAQYKGHQNWVKVTGEFLTFPGGGTQFQHGALHYIDFLNESVPGIAWGKRTRVILDVGCGVASFGGYLFDRDVLAMSFAPKDEHEAQIQFALERGIPAISAVMGTKRLPYPGRVFDAVHCARCRVPWHIEGGKLLLELNRVLRPGGFFVWSATPVYQKLAEDVEIWQAMTELTKAMCWELVSINKDTLNGVGVATYRKPTSNDCYEKRSKQEPPLCEASDDPNAAWNVPLQACMHKVPVGSLERGSQWPEQWPARLDKTPYWMLSSQVGVYGKPAPEDFTADYEHWKRVVSNSYLNGIGLNWSSVRNAMDMRSVYGGFAAALKELNVWVMNVVTADSPDTLPIIYERGLFGIYHDWCESFNTYPRSYDLLHADHLFSKVKKRCNLAAVFAEVDRILRPEGKLIVRDKVEIINELENMARSMQWEVRMTYSKDKEGLLCVQKSMWRPKESETINYAIA

SEQ ID NO: 479 - DNA, 2472 bp, Populus trichocarpa
  POPTR_0007s04340.1
atggcgttaggaaaatatagcagggtagacaatagaagacaaaattcgagttactgctcgacagtgacaatcacggtgtttgtgggtctctgcttggttggggtatggatgatgacatcgtcttctgtggttcctggacaaagtgttgatgctcctgctcaggaaaacaagaatgaggtgaagcaacaagttcctgagagcaatgaaatcaatcctaagcaacctgaggacagcccaggtgatttgcctgaggatgcaacacaaggagacagcaagaagcccgatgagaagccggaagagaagccggaggagaaaccagaagagaagccggaggacaagcaagaagagcagcctgaggagaagccagaagagaagcctgaggaaaaatctaatgaagataccaagtccgatgatgggtcaactactgagacacaaaatggaggaactaatgcagaggatggtgacactaaaatcaacaatggagaaacaaacacaaaagatggagggacaaagccagatgatggtgaaagtaatgcagctggacaaggagattccgaggagaattcaacggagaagaaacctggtactgatgagactgaaacaaaattggtcgagaatactggtgaaggtgaggatggggaaacagggaatgataagatagatgagaaggtggatcagaaagatagtaaggaggcggataaaagttctgatgggcaggccaacaaccagagttcaggcgagttacttccttcaggggctcagtcagagcttttgaatgaaacgaccactcagagcggttcgtggtcaactcaggcagcagagtcaaagaatgagaaggaaactcaaaagtcttctaatcaacaaggggggtacaattggaaactgtgcaatgtcactgctgggcctgattacatcccatgtcttgacaattggcaaaaaattaggagtcttcattctacaaagcactatgaacatcgagagaggcactgtcctgaagaacccccaacctgtcttgttcctcttcctgaaggatataaacgcccaattgagtggtctacaagcagggaaaagatatggtaccataatgttccccacaccaagcttgcacaaattaaggggcatcaaaactgggtgaaagttactggtgaattcctcactttccctggtggtggaacccagtttaagcatggcgctcttcattacattgacttcataaatgagtctgtgcctgacattgcatggggaaaacaaacccgtgtgatattggatgttggatgtggagttgctagctttggaggatatctctttgacagagatgttctaacaatgtcatttgcccctaaagatgagcatgaagctcaagtacaatttgctcttgaaagaggaatcccagctatatcagctgtgatgggaacaaagaggcttccctaccctggcagagtttttgatgctgttcattgtgcgcgctgtagagtaccgtggcatattgaaggtggtaaacttcttctggagctgaatcgtgtgttgcgacctggtggtttgtttgtgtggtctgctactcctgtttatcagaagctagctgaagatgttgaaatttggcaagccatgaccgaactaacaaaagctatgtgctgggaacttgtgtctattaacaaggacacaattaatggagtgggtgtagctacatacaggaagcctacttccaatgactgctatgagaaaagatcaaaacaagagcctccactttgtgaagcatctgatgatccaaacgcagcctggaatgtgccactgcaagcatgtatgcataaggtgcctgtagattcactggaacgtgggtctcaatggccagagcaatggccggcaaggttgggtaaaacaccttattggatgttgagttcccaagttggagtttatggtaaaccagcaccagaagatttcactgcagattatgagcactggaagcgggtggtctccaattcatatctaaatggaattggaataaactggtcatctgtgagaaatgccatggacatgagatctgtttatggaggttttgctgcagctctgaaggagttgaacgtgtgggtcatgaatgtgatcacggtagactcgccagatactctacctataatttatgaacgtgggctgtttggaatttatcatgattggtgtgaatcatttagcacttatcctagatcttatgatcttctccatgcggaccatctattctccaaggttaaaaagaggtgcagtatggtggctgtatttgcggaagttgatagaattctgaggccggaagggaagctcattgtccgggacaatgttgagaccatgaatgagctggagaacatggcaaggtctatgcagtgggaggttcgtatgacctactctaaggacaaggaaggattgctgtgtgtccagaaatccaagtggcgacccagagagtcagagacactcacttatgctattgct

SEQ ID NO: 480 - protein, 824 aa, Populus trichocarpa
  POPTR_0007s04340.1
MALGKYSRVDNRRQNSSYCSTVTITVFVGLCLVGVWMMTSSSVVPGQSVDAPAQENKNEVKQQVPESNEINPKQPEDSPGDLPEDATQGDSKKPDEKPEEKPEEKPEEKPEDKQEEQPEEKPEEKPEEKSNEDTKSDDGSTTETQNGGTNAEDGDTKINNGETNTKDGGTKPDDGESNAAGQGDSEENSTEKKPGTDETETKLVENTGEGEDGETGNDKIDEKVDQKDSKEADKSSDGQANNQSSGELLPSGAQSELLNETTTQSGSWSTQAAESKNEKETQKSSNQQGGYNWKLCNVTAGPDYIPCLDNWQKIRSLHSTKHYEHRERHCPEEPPTCLVPLPEGYKRPIEWSTSREKIWYHNVPHTKLAQIKGHQNWVKVTGEFLTFPGGGTQFKHGALHYIDFINESVPDIAWGKQTRVILDVGCGVASFGGYLFDRDVLTMSFAPKDEHEAQVQFALERGIPAISAVMGTKRLPYPGRVFDAVHCARCRVPWHIEGGKLLLELNRVLRPGGLFVWSATPVYQKLAEDVEIWQAMTELTKAMCWELVSINKDTINGVGVATYRKPTSNDCYEKRSKQEPPLCEASDDPNAAWNVPLQACMHKVPVDSLERGSQWPEQWPARLGKTPYWMLSSQVGVYGKPAPEDFTADYEHWKRVVSNSYLNGIGINWSSVRNAMDMRSVYGGFAAALKELNVWVMNVITVDSPDTLPIIYERGLFGIYHDWCESFSTYPRSYDLLHADHLFSKVKKRCSMVAVFAEVDRILRPEGKLIVRDNVETMNELENMARSMQWEVRMTYSKDKEGLLCVQKSKWRPRESETLTYAIA

SEQ ID NO: 481 - DNA, 2283 bp, Vitis vinifera
  GSVIVT01026451001
atggctttaggaaaatatagtagagtcgatggtaggagatcgaccaccaattattgttctacagcaactctggttgcttttgtggctctttgcttggttggggtttggatgatgacatcctcatctgtcgttccggttcaaaattcagatgtctcaactcaggagaccaaagatgaggtgaagcaacaagtggttgaaagtaatgatagtgatactaggcaatttgaggatagttccggtgatctaacagatgatgcaaagaagggggatggtgtgaatgggtcaacaaatgaggcagaaaacggggaaaacaaatctggggatggggaaggagattctaagacagaagatgcaaattcagattcaggagagacaaaaacagatggtggtgaaagtattgcagatggacagggtgattctgaagggggttcggttgagaagaaatctgagttggatgacagtgagaagaaatcagaggagaactcctttgaaactaaggatggagacaaagtggatggtcagatagaggagaaggatagtgaggccaaagaacaggtttcaaatgaggtatttccttctggggctatgtcagagctcctgaatgaaactaccactcaaaatggagcgttcttgactcaggcagcagagtctaagaaggaaaaagaaagccaacagactgtctacagttggaaagtttgcaatgtcactgctggaccagattacatcccatgccttgacaatttgcaagcaattaagagcctcccaagtaccaagcattatgaacaccgagagaggcactgccctaatgaaccacccacctgtcttgtttcacttcctgaaggatacaaacgtccaattgagtggccgacaagcagggataagatatggtactataacgttccccacaccaagcttgcagaaattaaagggcatcagaattgggtgaaggtttctggcgagttccttacttttcctggtggtggaacacagtttaagaatggtgctcttcattacattgaattcatagaggagtctatgcctgatattgcatggggaaaacgcagccgtgtggtattggatgttggatgtggtgttgctagctttggaggctatctttttgataaagatgtgctcactatgtcatttgccccaaaagacgagcatgaagcccaagtacaatttgcacttgaaaggggaattccgggtatatctgctgttatgggcacaaagagacttcccttcccagccatggtctttgatgttgtccactgtgcacgttgtagagttccctggcatatagaaggtggtaaacttctcttggagctgaaccgtgtgttgcggcctggtggtttctttgtgtggtcggcaactccggtttaccagaagcttgctgatgatgttgcgatatggaatgccatgactgaactgatgaagtcaatgtgctgggagcttgtggtgattaaaagggatgtggtgaatcgtgtggcagcagcaatatataagaagcctacttctaatgattgctatgagaaaagatcgcaaaatgaacctccaatctgtgccgattcagaagatgcaaatgctgcctggaatgtcccattgcaagcatgtatgcacaaagtgccagttgatgcatcgaaacgcggctctcaatggccagagctatggcctgcaaggttggataaaagtccatactggttgacaagttcccaggttggggtttatggcagagcagcaccggaggatttcactgcagactatgaacactggaaacgagtggttgctcagtcatatctaaatgggataggaatcagctggtcttctgtgagaaatgtcatggacatgagagctgtctacggaggatttgctgcagctttgagagatttgaatgtttgggtcatgaatgtggtctcaatagactctccagatacacttcctataatttatgaacgaggtctatttgggatttatcacaattggtgtgaatcattcaacacctaccctagatcatacgatctgttacatgcagaccatatcttctccaagaccaaaaagaagtgcaacctggtggctgtgattgcagaggctgatcggattctaaggcctgaaggaaagcttattgtccgtgatgatgtggagacacttggtcaggtggagaacatgcttaggtccatgcactgggaaatccggatgacttactccaaggagaaggagggattgctatgtgcccagaaaaccatgtggaggcctaaagagatggagataataaagtcggctattgct

SEQ ID NO: 482 - protein, 761 aa, Vitis vinifera
  GSVIVT01026451001
MALGKYSRVDGRRSTTNYCSTATLVAFVALCLVGVWMMTSSSVVPVQNSDVSTQETKDEVKQQVVESNDSDTRQFEDSSGDLTDDAKKGDGVNGSTNEAENGENKSGDGEGDSKTEDANSDSGETKTDGGESIADGQGDSEGGSVEKKSELDDSEKKSEENSFETKDGDKVDGQIEEKDSEAKEQVSNEVFPSGAMSELLNETTTQNGAFLTQAAESKKEKESQQTVYSWKVCNVTAGPDYIPCLDNLQAIKSLPSTKHYEHRERHCPNEPPTCLVSLPEGYKRPIEWPTSRDKIWYYNVPHTKLAEIKGHQNWVKVSGEFLTFPGGGTQFKNGALHYIEFIEESMPDIAWGKRSRVVLDVGCGVASFGGYLFDKDVLTMSFAPKDEHEAQVQFALERGIPGISAVMGTKRLPFPAMVFDVVHCARCRVPWHIEGGKLLLELNRVLRPGGFFVWSATPVYQKLADDVAIWNAMTELMKSMCWELVVIKRDVVNRVAAAIYKKPTSNDCYEKRSQNEPPICADSEDANAAWNVPLQACMHKVPVDASKRGSQWPELWPARLDKSPYWLTSSQVGVYGRAAPEDFTADYEHWKRVVAQSYLNGIGISWSSVRNVMDMRAVYGGFAAALRDLNVWVMNVVSIDSPDTLPIIYERGLFGIYHNWCESFNTYPRSYDLLHADHIFSKTKKKCNLVAVIAEADRILRPEGKLIVRDDVETLGQVENMLRSMHWEIRMTYSKEKEGLLCAQKTMWRPKEMEIIKSAIA

SEQ ID NO: 483 - protein, 48 aa, Arabidopsis thaliana
  AT3G53200.1, Myb1 domain 11-58
RGPWLEEEDERLVKVISLLGERRWDSLAIVSGLKRSGKSCRLRWMNYL

SEQ ID NO: 484 - protein, 48 aa, Glycine max
  Glyma10g06680.1, Myb1 domain 8-55
KGTWLQEEDEQLTSFVTRLGERRWDSLAKVAGLKRSGKSCRLRWMNYL

SEQ ID NO: 485 - protein, 48 aa, Glycine max
  Glyma13g20880.1, Myb1 domain 8-55
KGTWLQEEDEQLTSFVARLGERRWDSLAKVAGLKRSGKSCRLRWMNYL

SEQ ID NO: 486 - protein, 48 aa, Citrus clementina
  clementine0.9_029544m, Myb1 domain 38-85
KGPWHEEEDELLVTFVTLFGERRWDYIAKASGLKRSGKSCRLRWLNYL

SEQ ID NO: 487 - protein, 48 aa, Eucalyptus grandis
  Eucgr.A01648.1, Myb1 domain 15-62
KGPWIEQEDEILTAFVTVLGERRWDYIAKTSGLKRSGKSCRLRWKNYL

SEQ ID NO: 488 - protein, 48 aa, Populus trichocarpa
  POPTR_0006s12400.1, Myb domain 10-57
KGSWQEEEDERLTASATLLGERKWDSIARLSGLMRSGKSCRMRWLNYL

SEQ ID NO: 489 - protein, 48 aa, Vitis vinifera
  GSVIVT01033670001, Myb1 domain 8-55
KGSWLEEEDERLTAFVGLLGERRWDSIARASGLKRSGKSCRLRWLNYL

SEQ ID NO: 490 - protein, 46 aa, Arabidopsis thaliana
  AT3G53200.1, Myb2 domain 64-109
RGPMSQEEERIIFQLHALWGNKWSKIARRLPGRTDNEIKNYWRTHY

SEQ ID NO: 491 - protein, 46 aa, Glycine max
  Glyma10g06680.1, Myb2 domain 61-106
HGHFSVEEEQLIVQLQQQLGNKWAKIARKLPGRTDNEIKNFWRTHL

SEQ ID NO: 492 - protein, 46 aa, Glycine max
  Glyma13g20880.,1 Myb2 domain 61-106
HGHFSVEEEQLIVQLQQELGNKWAKIARKLPGRTDNEIKNYWKTHL

SEQ ID NO: 493 - protein, 49 aa, Citrus clementina
  clementine0.9_029544m, Myb2 domain 91-139
HGYISTEEEQIIIQLHKNIKIYLHGWSRIARSLPGRTDNEIKNCWRTRI

SEQ ID NO: 494 - protein, 46 aa, Eucalyptus grandis
  Eucgr.A01648.1, Myb2 domain 68-113
HGPISPEEERIIIKFHEQWGNKWSRIAEKLPGRTDNEIKNFWKTHL

SEQ ID NO: 495 - protein, 46 aa, Populus trichocarpa
  POPTR_0006s12400.1, Myb2 domain 63-108
RGHISAEEEQIIIQFHGQWGNKWARIARRLPGRTDNEIKNYWRTHM

SEQ ID NO: 496 - protein, 46 aa, Vitis vinifera
  GSVIVT01033670001, Myb2 domain 61-106
RCQISAEEEQIILQLHKRWGNKWSWIARSLPGRTDNEIKNYWRTHL

SEQ ID NO: 497 - protein, 79 aa, Brachypodium distachyon
  Bradi5g22410.1, RRM1 domain 89-167
TLWIGDLQYWMDETYIHGCFASTGELQSVKLIRDKQTGQLQGYGFVEFTSHAAAERVLQGYNGHAMPNVDLAYRLNWAS

SEQ ID NO: 498 - protein, 79 aa, Zea mays
  GRMZM2G012628_T01, RRM1 domain 93-171
TLWIGDLQYWMDENYVFGCFSNTGEVQNVKLIRDKNSGQLQGYGFVEFTSRAAAERVLQTYNGQMMPNVDLTFRLNWAS

SEQ ID NO: 499 - protein, 79 aa, Zea mays
  GRMZM2G058098_T02, RRM1 domain 175-254
TLWIGDLQYWMDDNYVFGCFSNTGEVQNVKLIRDKNSGQLQGYGFVEFTSRAAAERVLQTYNGQMMPNVDLTFRLNWAS

SEQ ID NO: 500 - protein, 79 aa, Brachypodium distachyon
  Bradi3g15180.1, RRM1 domain 99-177
TLWIGDLQYWMDENYVYGCFAHTGEVQSVKLIRDKQTGQLQGYGFVEFTTRAGAERVLQTYNGATMPNVEMPYRLNWAS

SEQ ID NO: 501 - protein, 79 aa, Oryza sativa
  LOC_Os08g09100.1, RRM1 domain 96-174
TLWIGDLQYWMDENYISACFAPTGELQSVKLIRDKQTGQLQGYGFIEFTSHAGAERVLQTYNGAMMPNVEQTYRLNWAS

SEQ ID NO: 502 - protein, 79 aa, Zea mays
  GRMZM2G426591_T01, RRM1 domain 122-200
TLWIGDLQYWMDDNYIYGCFASTGEVQNVKLIRDKHTGQLQGYGFIEFISRAAAERVLQTYNGTMMPNVELPFRLNWAS

SEQ ID NO: 503 - protein, 83 aa, Brachypodium distachyon
  Bradi1g26210.1, RRM1 domain 115-197
SLWIGDLQYWMDEAYLHNAFAPMGPQQVASVKIIRNKQTGQPEGYGFIEFHSRAAAEYALASFNGHAMPNVDLPFKLNWASAS

SEQ ID NO: 504 - protein, 82 aa, Oryza sativa
  LOC_Os07g33330.1, RRM1 domain 129-210
SLWIGDLQYWMDESYLSNAFAPMGQQVTSVKVIRNKQSGHSEGYGFIEFQSHAAAEYALANFNGRMMLNVDQLFKLNWASSG

SEQ ID NO: 505 - protein, 85 aa, Zea mays
  GRMZM2G127510_T01, RRM1 domain 115-199
TLWIGDLQHWMDENYLHYNAFAAVAQQIASVKIIRNKQTGHSEGYGFIEFYSRAAAEHTLMNFNGQMMPNVEMTFKLNWASASTG

SEQ ID NO: 506 - protein, 85 aa, Zea mays
  GRMZM2G169615_T01, RRM1 domain 147-231
TLWIGDLQYWMDENYLHYNAFAPVAQQIASVKIIRNKQTGHSEGYGFIEFYSQAAAEHTLMNFNGQMMPNIEMAFKLNWASASTG

SEQ ID NO: 507 - protein, 81 aa, Oryza sativa
  LOC_Os03g37270.1, RRM1 domain 68-148
TLWIGDLQFWMEENYLYNCFSQAGELISAKIIRNKQTGQPEGYGFIEFGSHAIAEQVLQGYNGQMMPNGNQVFKLNWATSG

SEQ ID NO: 508 - protein, 81 aa, Zea mays
  GRMZM2G002874_T01, RRM1 domain 71-151
TLWIGDLQYWMDENYLYSCFSQAGEVISVKIIRNKQTGQPEGYGFIEFSNHAVAEQVLQNYNGQMMPNVNQPFKLNWATSG

SEQ ID NO: 509 - protein, 81 aa, Arabidopsis thaliana
  AT4G27000.1, RRM1 domain 81-161
SLWIGDLQPWMDENYLMNVFGLTGEATAAKVIRNKQNGYSEGYGFIEFVNHATAERNLQTYNGAPMPSSEQAFRLNWAQLG

SEQ ID NO: 510 - protein, 81 aa, Arabidopsis thaliana
  AT5G54900.1, RRM1 domain 61-141
SLWIGDLQQWMDENYIMSVFAQSGEATSAKVIRNKLTGQSEGYGFIEFVSHSVAERVLQTYNGAPMPSTEQTFRLNWAQAG

SEQ ID NO: 511 - protein, 80 aa, Populus trichocarpa
  POPTR_0001s45000.1, RRM1 domain 68-147
SLWIGDLQQWMDENYILSIFSTTGEVVQAKVIRNKQTGYPEGYGFIEFVSHAAAERILQTYNGTPMPNSEQTFRLNWATL

SEQ ID NO: 512 - protein, 81 aa, Populus trichocarpa
  POPTR_0011s14150.1, RRM1 domain 71-151
SLWIGDLQQWMDENYLLSIFSATGEIVQAKVIRNKQTGYPEGYGFIEFVSRAAAERILQTYNGTPMPNSEQAFRLNWATLG

SEQ ID NO: 513 - protein, 81 aa, Solanum lycopersicum
  Solyc07g064510.2.1, RRM1 domain 82-162
SLWIGDLQYWMDESYLSTCFYHTGELVSAKVIRNKQSGQSEGYGFLEFRSHAAAETVLQTYNGALMPNVEQNFRMNWASLG

SEQ ID NO: 514 - protein, 81 aa, Eucalyptus grandis
  Eucgr.F03462.1, RRM1 domain 65-145
SLWIGDLQPHMDETYLLNCFAHSGEVLSAKVIRNKQTALPEGYGFIEFMTRAAAERILQTYNGTLMPNSDQNFRLNWATLG

SEQ ID NO: 515 - protein, 82 aa, Arabidopsis thaliana
  AT1G11650.2, RRM1 domain 63-144
TLWIGDLQYWMDENFLYGCFAHTGEMVSAKVIRNKQTGQVEGYGFIEFASHAAAERVLQTFNNAPIPSFPDQLFRLNWASLS

SEQ ID NO: 516 - protein, 81 aa, Populus trichocarpa
  POPTR_0004s01690.1, RRM1 domain 78-158
TLWIGDLQYWMDENYIASCFAHTGEVASVKIIRNKQTSQIEGYGFIEMTSHGAAERILQTYNGTPMPNGEQNFRLNWASFS

SEQ ID NO: 517 - protein, 79 aa, Eucalyptus grandis
  Eucgr.D01310.1, RRM1 domain 93-171
TLWIGDLQYWMDEAYLGTCFAATGEVANVKVIRNKQTMQPEGYGFIEFYTRAAAERVLQTYNGAIMPNGGQSFRLNWAS

SEQ ID NO: 518 - protein, 81 aa, Glycine max
  Glyma07g38940.1, RRM1 domain 62-142
TLWIGDLQYWMDENYLYTCLAHTGEVASVKVIRNKQTSQSEGYGFIEFTSRAGAERVLQTYNGTIMPNGGQNFRLNWATLS

SEQ ID NO: 519 - protein, 81 aa, Glycine max
  Glyma17g01800.1, RRM1 domain 66-146
TLWIGDLQYWMDENYLYTCFAHTGELASVKVIRNKQTSQSEGYGFIEFTSRAGAERVLQTYNGTIMPNGGQNFRLNWATFS

SEQ ID NO: 520 - protein, 81 aa, Glycine max
  Glyma13g27570.1, RRM1 domain 67-147
TLWIGDLQYWMDENYLYTCFAHTGEVTSVKVIRNKQTSQSEGYGFIEFNSRAGAERILQTYNGAIMPNGGQSFRLNWATFS

SEQ ID NO: 521 - protein, 81 aa, Glycine max
  Glyma15g11380.1, RRM1 domain 68-148
TLWIGDLQYWMDENYLYTCFAHTGEVSSVKVIRNKQTSQSEGYGFIEFNSRAGAERILQTYNGAIMPNGGQSFRLNWATFS

SEQ ID NO: 522 - protein, 81 aa, Solanum lycopersicum
  Solyc02g080420.2.1, RRM1 domain 80-160
SLWIGDLQFWMDEQYLLNCFAQTGEVTSAKVIRNKQSGQSEGYGFIEFISHAAAERNLQAYNGTLMPNIEQNFRLNWASLG

SEQ ID NO: 523 - protein, 81 aa, Solanum lycopersicum
  Solyc10g005260.2.1, RRM1 domain 77-157
TLWIGDLQFWMDEQYLYSCFAQTGEVVSAKVIRNKQTQQSEGYGFIEFNSHAAAERNLQAYNGTLMPNIEQNFRLNWASLG

SEQ ID NO: 524 - protein, 81 aa, Solanum lycopersicum
  Solyc03g031720.2.1, RRM1 domain 73-153
SLWIGDLQFWMDEQYIQNCFAHTGEVASVKVIRNKQSGQSEGYGFVEFISHAAAERNLQTYNGSMMPNSEQPFRLNWASLG

SEQ ID NO: 525 - protein, 80 aa, Brachypodium distachyon
  Bradi5g22410.1, RRM2 domain 177-256
DYTIFVGDLAADVTDYILQETFRVHYPSVKGAKVVTDKMTMRSKGYGFVKFGDPTEQARAMTEMNGMPCSSRPMRIGPAA

SEQ ID NO: 526 - protein, 80 aa, Zea mays
  GRMZM2G012628_T01, RRM2 domain 181-260
EYTIFVGDLAADVTDYLLQETFRVHYPSVKGAKVVTDKLTMRTKGYGFVKFGDPTEQARAMTEMNGMPCSSRPMRIGPAA

SEQ ID NO: 527 - protein, 80 aa, Zea mays
  GRMZM2G058098_T02, RRM2 domain 282-354
DYTIFVGDLAADVTDYLLQETFRVHYPSVKGAKVVTDKLTMRTKGYGFVKFGDPTEQARAMTEMNGMPCSSRPMRIGPAA

SEQ ID NO: 528 - protein, 80 aa, Brachypodium distachyon
  Bradi3g15180.1, RRM2 domain 187-266
DYTIFVGDLAADVTDYILQETFRVHYPSVKGAKVVTDKLTMRSKGYGFVKFSDPTEQTRAMTEMNGMVCSSRPMRIGPAA

SEQ ID NO: 529 - protein, 80 aa, Oryza sativa
  LOC_Os08g09100.1, RRM2 domain 184-263
DYTIFVGDLAADVTDYILQETFRVHYPSVKGAKVVTDKMTMRSKGYGFVKFGDPSEQARAMTEMNGMVCSSRPMRIGPAA

SEQ ID NO: 530 - protein, 80 aa, Zea mays
  GRMZM2G426591_T01, RRM2 domain 210-289
DYTIFVGDLAADVTDYVLQETFRAHYPSVKGAKVVTDKLTMRTKGYGFVKFGDPNEQARAMTEMNGMLCSSRPMRIGPAA

SEQ ID NO: 531 - protein, 80 aa, Brachypodium distachyon
  Bradi1g26210.1, RRM2 domain 208-287
DHTIFVGDLASDVTDSMLQEIFKASYPSVRGANVVTDRATGRSKGYGFVRFGDVNEQTRAMTEMNGVTLSSRQLRIGPAA

SEQ ID NO: 532 - protein, 80 aa, Oryza sativa
  LOC_Os07g33330.1, RRM2 domain 222-301
EHTIFVGDLASDVTDSMLEEAFKTSYPSVRGAKVVFDKVTGRSKGYGFVRFGDENEQTRAMTEMNGATLSTRQMRLGPAA

SEQ ID NO: 533 - protein, 80 aa, Zea mays
  GRMZM2G127510_T01, RRM2 domain 208-287
DRTIFVGDLAHDVTDSMLEDVFRAKYPSVRGANVVVDRMTGWPKGFGFVRFGDLNEQARAMTEMNGMLLSTRQMRIGAAA

SEQ ID NO: 534 - protein, 80 aa, Zea mays
  GRMZM2G169615_T01, RRM2 domain 240-319
DHAIFVGDLAPDVTDSMLEDVFRANYPSVRGAKVVVDRITGRPKGYGFVHFGDLNEQARAMTEMNGMMLSTRKMRIGAAA

SEQ ID NO: 535 - protein, 80 aa, Oryza sativa
  LOC_Os03g37270.1, RRM2 domain 159-238
DYTIFVGDLASDVTDLILQDTFKAHYQSVKGAKVVFDRSTGRSKGYGFVKFGDLDEQTRAMTEMNGQYCSSRPMRIGPAS

SEQ ID NO: 536 - protein, 80 aa, Zea mays
  GRMZM2G002874_T01, RRM2 domain 162-241
DYTIFVGDLASDVTDFILQDTFKSRYPSVKGAKVVFDRTTGRSKGYGFVKFADSDEQTRAMTEMNGQYCSSRAMRLGPAS

SEQ ID NO: 537 - protein, 80 aa, Arabidopsis thaliana
  AT4G27000.1, RRM2 domain 172-251
EHTVFVGDLAPDVTDHMLTETFKAVYSSVKGAKVVNDRTTGRSKGYGFVRFADESEQIRAMTEMNGQYCSSRPMRTGPAA

SEQ ID NO: 538 - protein, 80 aa, Arabidopsis thaliana
  AT5G54900.1, RRM2 domain 153-232
DHTIFVGDLAPEVTDYMLSDTFKNVYGSVKGAKVVLDRTTGRSKGYGFVRFADENEQMRAMTEMNGQYCSTRPMRIGPAA

SEQ ID NO: 539 - protein, 80 aa, Populus trichocarpa
  POPTR_0001s45000.1, RRM2 domain 159-238
DYTVFIGDLAADVNDYLLQETFRNVYSSVKGAKVVTDRVTGRSKGYGFVRFADENEQMRAMVEMNGQYCSTRPMRIGPAA

SEQ ID NO: 540 - protein, 80 aa, Populus trichocarpa
  POPTR_0011s14150.1, RRM2 domain 162-241
DFTVFVGDLAADVNDYLLQETFRNVYPSVKGAKVVTDRVTGRSKGYGFIRFADENEQRRAMVEMNGQYCSTRPMRIGPAA

SEQ ID NO: 541 - protein, 80 aa, Solanum lycopersicum
  Solyc07g064510.2.1, RRM2 domain 172-251
EYTIFVGDLAADVTDYVLQETFKPVYSSVKGAKVVTDRITGRTKGYGFVKFSDESEQLRAMTEMNGVLCSSRPMRIGPAA

SEQ ID NO: 542 - protein, 80 aa, Eucalyptus grandis
  Eucgr.F03462.1, RRM2 domain 156-235
DYTIFVGDLAADVTDHMLQETFRAHYPSVKGAKIVIDRTTGRSKGYGFVRFGDETEQLRAMTEMNGMYCSSRPMRIGPAA

SEQ ID NO: 543 - protein, 80 aa, Arabidopsis thaliana
  AT1G11650.2, RRM2 domain 157-233
DYTIFVGDLAADVTDYILLETFRASYPSVKGAKVVIDRVTGRTKGYGFVRFSDESEQIRAMTEMNGVPCSTRPMRIGPAA

SEQ ID NO: 544 - protein, 80 aa, Populus trichocarpa
  POPTR_0004s01690.1, RRM2 domain 168-247
DFTIFVGDLAADVTDFMLQETFRAHFPSVKGAKVVIDRLTGRTKGYGFVRFGDESEQLRAMTEMNGAFCSTRPMRVGLAS

SEQ ID NO: 545 - protein, 80 aa, Eucalyptus grandis
  Eucgr.D01310.1, RRM2 domain 182-261
DYTIFVGDLASDVTDYMLQEMFRGRYPSVRSAKVVMDRLTSRTKGYGFVKFGDESEQIRAMSEMNGVFLSTRPMRIGLAT

SEQ ID NO: 546 - protein, 80 aa, Glycine max
  Glyma07g38940.1, RRM2 domain 153-232
DHTIFVGDLAADVTDYLLQETFRARYPSIKGAKVVIDRLTGRTKGYGFVRFGDESEQVRAMTEMQGVLCSTRPMRIGPAS

SEQ ID NO: 547 - protein, 80 aa, Glycine max
  Glyma17g01800.1, RRM2 domain 157-236
DHTIFVGDLAADVTDYLLQETFRARYPSAKGAKVVIDRLTGRTKGYGFVRFGDESEQVRAMSEMQGVLCSTRPMRIGPAS

SEQ ID NO: 548 - protein, 80 aa, Glycine max
  Glyma13g27570.1, RRM2 domain 159-238
DYTIFVGDLAADVTDYLLQETFRARYNSVKGAKVVIDRLTGRTKGYGFVRFSDESEQVRAMTEMQGVLCSTRPMRIGPAS

SEQ ID NO: 549 - protein, 80 aa, Glycine max
  Glyma15g11380.1, RRM2 domain 160-239
DYTIFVGDLAADVTDYLLQETFRARYNSVKGAKVVIDRLTGRTKGYGFVRFSEESEQMRAMTEMQGVLCSTRPMRIGPAS

SEQ ID NO: 550 - protein, 80 aa, Solanum lycopersicum
  Solyc02g080420.2.1, RRM2 domain 171-250
EYTIFVGDLAADVSDYMLQETFRANYPSVKGAKVVTDKATGRTKGYGFVKFGDESEQLRAMTEMNGQFCSTRPMRIGPAA

SEQ ID NO: 551 - protein, 80 aa, Solanum lycopersicum
  Solyc10g005260.2.1, RRM2 domain 168-247
EYTIFVGDLAADVTDYMLQETFRPNYPSIKGAKVVTDRATGHTKGYGFVRFGDESEQLRAMTEMNGKFCSTRPMRIGPAA

SEQ ID NO: 552 - protein, 80 aa, Solanum lycopersicum
  Solyc03g031720.2.1, RRM2 domain 164-243
EYTIFVGDLAADVTDYMLQETFRANYPSVKGAKVVTDRVTGRTKGYGFVKFADESEQLHAMTEMNGKFCSTRPMRIGPAA

SEQ ID NO: 553 - protein, 73 aa, Brachypodium distachyon
  Bradi5g22410.1, RRM3 domain 284-356
TTIFVGGLDPNVTEDALKQVFAPYGEVIHVKIPVGKRCGFVQFVNRPSAEQALQMLQGTPIGGQNVRLSWGRS

SEQ ID NO: 554 - protein, 73 aa, Zea mays
  GRMZM2G012628_T01, RRM3 domain 288-360
TTIFVGGLDPNVTEDTLKQVFSPYGEVVHVKIPVGKRCGFVQFVTRPSAEQALLMLQGALIGAQNVRLSWGRS

SEQ ID NO: 555 - protein, 73 aa, Zea mays
  GRMZM2G058098_T02, RRM3 domain 260-332
TTIFVGGLDPNVTEDVLKQAFSPYGEVIHVKIPVGKRCGFVQFVTRPSAEQALLMLQGALIGAQNVRLSWGRS

SEQ ID NO: 556 - protein, 73 aa, Brachypodium distachyon
  Bradi3g15180.1, RRM3 domain 293-365
TTIFVGGLDPNVTEDMLKQVFAPYGEVVHVKIPVGKRCGFVQYASRSSSEEALLMLQGTVIGGQNVRLSWGRS

SEQ ID NO: 557 - protein, 73 aa, Oryza sativa
  LOC_Os08g09100.1, RRM3 domain 289-361
TTIFVGGLDPSVTDDMLKQVFTPYGDVVHVKIPVGKRCGFVQFANRASADEALVLLQGTLIGGQNVRLSWGRS

SEQ ID NO: 558 - protein, 73 aa, Zea mays
  GRMZM2G426591_T01, RRM3 domain 315-387
TTIFVGGLDPNVTEDMLKQVFTPYGDVVHVKIPVGKRCGFVQYANRSSAEEALVILQGTLVGGQNVRLSWGRS

SEQ ID NO: 559 - protein, 73 aa, Brachypodium distachyon
  Bradi1g26210.1, RRM3 domain 320-392
TTIFVGGLDSNIDENYLRQVFTPYGEVGYVKIPVGKRCGFVQFTSRSCAEEAINALNGTPIGGNNVRLSWGRS

SEQ ID NO: 560 - protein, 73 aa, Oryza sativa
  LOC_Os07g33330.1, RRM3 domain 332-404
TTIFVGGLDSNVNEDHLKQVFTPYGEIGYVKIPLGKRCGFVQFTSRSSAEEAIRVLNGSQIGGQQVRLSWGRT

SEQ ID NO: 561 - protein, 73 aa, Zea mays
  GRMZM2G127510_T01, RRM3 domain 319-391
TTVFVGGLDSNVNEEYLRQIFTPYGEISYVKIPVGKHCGFVQFTSRSCAEEAIRMLNGSQVGGQKVRLSWGRS

SEQ ID NO: 562 - protein, 73 aa, Zea mays
  GRMZM2G169615_T01, RRM3 domain 351-423
TTVFVGGLDSNVDEEYLRQIFTPYGEISYVKIPVGKHCGFVQFTSRSCAEEAIQMLNGSQIGGQKARLSWGRS

SEQ ID NO: 563 - protein, 73 aa, Oryza sativa
  LOC_Os03g37270.1, RRM3 domain 268-340
TTVFVGGLDPSVTDEVLKQAFSPYGELVYVKIPVGKRCGFVQYSNRASAEEAIRMLNGSQLGGQSIRLSWGRS

SEQ ID NO: 564 - protein, 73 aa, Zea mays
  GRMZM2G002874_T01, RRM3 domain 271-343
TTVFVGGLDPSVTDELLKQTFSPYGELLYVKIPVGKRCGFVQYSNRASAEEAIRVLNGSQLGGQSIRLSWGRS

SEQ ID NO: 565 - protein, 73 aa, Arabidopsis thaliana
  AT4G27000.1, RRM3 domain 278-350
TTIFVGAVDQSVTEDDLKSVFGQFGELVHVKIPAGKRCGFVQYANRACAEQALSVLNGTQLGGQSIRLSWGRS

SEQ ID NO: 566 - protein, 73 aa, Arabidopsis thaliana
  AT5G54900.1, RRM3 domain 260-332
TTIFVGGLDANVTDDELKSIFGQFGELLHVKIPPGKRCGFVQYANKASAEHALSVLNGTQLGGQSIRLSWGRS

SEQ ID NO: 567 - protein, 73 aa, Populus trichocarpa
  POPTR_0001s45000.1, RRM3 domain 267-339
TTIFVGALDPSVTDDTLRAVFSKYGELVHVKIPAGKRCGFVQFANRTCAEQALSMLNGTQIAGQNIRLSWGRS

SEQ ID NO: 568 - protein, 73 aa, Populus trichocarpa
  POPTR_0011s14150.1, RRM3 domain 270-342
TTIFVGALDPSVTDDTLRAVFSKYGELVHVKIPAGKRCGFVQFANRTSAEQALSMLNGTQIAGQNIRLSWGRS

SEQ ID NO: 569 - protein, 73 aa, Solanum lycopersicum
  Solyc07g064510.2.1, RRM3 domain 279-351
TTIFVGGLDPSVAEEHLRQVFSPYGELVHVKIVAGKRCGFVQFGSRASAEQALSSLNGTQLGGQSIRLSWGRS

SEQ ID NO: 570 - protein, 73 aa, Eucalyptus grandis
  Eucgr.F03462.1, RRM3 domain 265-337
TTIFVGGLDPSVSDDLLRQVFSQYGELHHVKIPPGKRCGFVQFTSRACAEQALLMLNGTQLGGQSIRLSWGRS

SEQ ID NO: 571 - protein, 73 aa, Arabidopsis thaliana
  AT1G11650.2, RRM3 domain 261-333
TTVFVGGLDASVTDDHLKNVFSQYGEIVHVKIPAGKRCGFVQFSEKSCAEEALRMLNGVQLGGTTVRLSWGRS

SEQ ID NO: 572 - protein, 73 aa, Populus trichocarpa
  POPTR_0004s01690.1, RRM3 domain 276-348
TTIFVGNLDSNVMDDHLKELFGQYGQLLHVKIPAGKRCGFVQFADRSSAEEALKMLNGAQLSGQNIRLSWGRN

SEQ ID NO: 573 - protein, 73 aa, Eucalyptus grandis
  Eucgr.D01310.1, RRM3 domain 291-363
KTVFVGGLDPNVTDDHLRQVFGQYGEIVQVKIPPGKRCGFVQFADRSCAEEALRMLNGTQLGGQNIRLSWGRS

SEQ ID NO: 574 - protein, 73 aa, Glycine max
  Glyma07g38940.1, RRM3 domain 261-333
TTIFVGNLDPNVTDDHLRQVFGHYGELVHVKIPAGKRCGFVQFADRSCAEEALRVLNGTLLGGQNVRLSWGRS

SEQ ID NO: 575 - protein, 73 aa, Glycine max
  Glyma17g01800.1, RRM3 domain 265-337
TTIFVGNLDPNVTDDHLRQVFGQYGELVHVKIPAGKRCGFVQFADRSCAEEALRVLNGTLLGGQNVRLSWGRS

SEQ ID NO: 576 - protein, 73 aa, Glycine max
  Glyma13g27570.1, RRM3 domain 269-341
TTIFVGNLDPNVTDDHLRQVFSQYGELVHVKIPAGKRCGFVQFADRSCAEEALRVLNGTLLGGQNVRLSWGRS

SEQ ID NO: 577 - protein, 73 aa, Glycine max; identical to SEQ ID NO: 576
  Glyma15g11380.1, RRM3 domain 270-342

SEQ ID NO: 578 - protein, 73 aa, Solanum lycopersicum
  Solyc02g080420.2.1, RRM3 domain 278-350
TTIFVGNLDSNITDEHLRQIFGHYGQLLHVKIPVGKRCGFIQFADRSCAEEALRVLNGTQLGGQSIRLSWGRS

SEQ ID NO: 579 - protein, 73 aa, Solanum lycopersicum
  Solyc10g005260.2.1, RRM3 domain 274-346
TTIFVGNLDASVTDDHLRQVFGNYGQLLHVKIPLGKRCGFVQFTDRSCAEEALNALSGTQLGGQTIRLSWGRS

SEQ ID NO: 580 - protein, 73 aa, Solanum lycopersicum
  Solyc03g031720.2.1, RRM3 domain 271-343
TTIFVGNLDANVTDDHLRQVFGNYGQLLHVKIPVGKRCGFVQFADRSCAEEALRALSGTQLGGQTIRLSWGRS

SEQ ID NO: 581 - protein, 62 aa, Brachypodium distachyon
  Bradi2g59240.1, TCP domain 84-145
KRSSNKDRHTKVDGRGRRIRMPALCAARIFQLTRELGHKSDGETVQWLLQQAEPAIVAATGS

SEQ ID NO: 582 - protein, 62 aa, Oryza sativa
  LOC_Os01g69980.11, TCP domain 83-144
KRSSNKDRHTKVDGRGRRIRMPALCAARIFQLTRELGHKSDGETVQWLLQQAEPAIVAATGT

SEQ ID NO: 583 - protein, 62 aa, Zea mays; identical to SEQ ID NO: 582
  GRMZM2G034638_T011, TCP domain 88-149

SEQ ID NO: 584 - protein, 62 aa, Zea mays; identical to SEQ ID NO: 582
  GRMZM2G092214_T011, TCP domain 98-159

SEQ ID NO: 585 - protein, 62 aa, Zea mays; identical to SEQ ID NO: 582
  GRMZM2G092214_T021, TCP domain 98-159

SEQ ID NO: 586 - protein, 63 aa, Eucalyptus grandis
  Eucgr.B03529.1, TCP domain 40-101
PKRSSNKDRHKKVDGRGRRIRMPALCAARIFQLTRELGHKTDGETIQWLLQQAEPSIVAATGT

SEQ ID NO: 587 - protein, 62 aa, Arabidopsis thaliana
  AT3G27010.1, TCP domain 74-135
KRSSNKDRHTKVEGRGRRIRMPALCAARIFQLTRELGHKSDGETIQWLLQQAEPSIIAATGS

SEQ ID NO: 588 - protein, 62 aa, Arabidopsis thaliana
  AT5G41030.1, TCP domain 64-125
KKKPNKDRHLKVEGRGRRVRLPPLCAARIYQLTKELGHKSDGETLEWLLQHAEPSILSATVN

SEQ ID NO: 589 - protein, 62 aa, Citrus clementina
  clementine0.9_016144m, TCP domain 66-127
KRSSNKDRHTKVEGRGRRIRMPALCAARIFQLTRELGHKSDGETIQWLLQQAEPSIIAATGT

SEQ ID NO: 590 - protein, 62 aa, Citrus clementina; identical to SEQ ID NO: 589
  clementine0.9_016174m, TCP domain 66-127

SEQ ID NO: 591 - protein, 62 aa, Populus trichocarpa; identical to SEQ ID NO: 589
  POPTR_0001s33470.1, TCP domain 78-139

SEQ ID NO: 592 - protein, 62 aa, Populus trichocarpa; identical to SEQ ID NO: 589
  POPTR_0017s09820.1, TCP domain 83-144

SEQ ID NO: 593 - protein, 62 aa, Glycine max; identical to SEQ ID NO: 589
  Glyma16g05840.1, TCP domain 68-129

SEQ ID NO: 594 - protein, 62 aa, Glycine max; identical to SEQ ID NO: 589
  Glyma19g26560.1, TCP domain 68-129

SEQ ID NO: 595 - protein, 62 aa, Citrus clementina
  clementine0.9_018374m, TCP domain 30-91
KRSSNKDRHKKVDGRGRRIRMPALCAARIFQLTRELGHKSDGETIQWLLQQAEPSIIAATGT

SEQ ID NO: 596 - protein, 62 aa, Populus trichocarpa
  POPTR_0001s13500.1, TCP domain 60-121
KRSSNKDRHKKVDGRGRRIRMPALCAARIFQLTRELGNKSDGETIQWLLQQAEPSIIAATGT

SEQ ID NO: 597 - protein, 62 aa, Populus trichocarpa
  POPTR_0003s16630.1, TCP domain 60-121
KRSSNKDRHKKVEGRGRRIRIPALCAARIFQLTRELEHKSDGETIQWLLQQAEPSIIAATGT

SEQ ID NO: 598 - protein, 62 aa, Solanum lycopersicum
  Solyc02g094290.1.1, TCP domain 33-94
KRKSNKDRHTKVEGRGRRIRMPALCAARIFQLTRELGHKSDGETIQWLLQKAEPSIIAATGH

SEQ ID NO: 599 - protein, 57 aa, Arabidopsis thaliana
  AT2G46970.1, bHLH domain 227-283
RKRSTEVHKLYERKRRDEFNKKMRALQDLLPNCYKDDKASLLDEAIKYMRTLQLQVQ

SEQ ID NO: 600 - protein, 57 aa, Arabidopsis thaliana
  AT3G62090.2, bHLH domain 186-242
RKRNAEAYNSPERNQRNDINKKMRTLQNLLPNSHKDDNESMLDEAINYMTNLQLQVQ

SEQ ID NO: 601 - protein, 57 aa, Citrus clementina
  clementine0.9_007946m, bHLH domain 306-365
KKRTPEVHKRYERKRRDKINKKMRALQELIPNCNKVDKASVLEEAIDYLKTLQFQVM

SEQ ID NO: 602 - protein, 57 aa, Glycine max
  Glyma10g27910.1, bHLH domain 187-243
RSRNAEVHNLCERKRRDKINKRMRILKELIPNCNKTDKASMLDDAIEYLKTLKLQLQ

SEQ ID NO: 603 - protein, 57 aa, Populus trichocarpa
  POPTR_0014s10700.1, bHLH domain 379-435
RRRATEIHNLSERKRRDRINKKMRALQDLIPNSNKVDKASMLGEAIDYLKSLQLQVQ

SEQ ID NO: 604 - protein, 51 aa, Brachypodium distachyon
  Bradi2g62067.1, SANT domain 116-166
RMVWNPQLHKRFVDVVAHLGIKSAVPKTIMQLMNVEGLTRENVASHLQKYR

SEQ ID NO: 605 - protein, 51 aa, Oryza sativa
  LOC_Os01g74020.1, SANT domain 120-170
RLVWTPQLHKRFVEVVAHLGMKNAVPKTIMQLMNVEGLTRENVASHLQKYR

SEQ ID NO: 606 - protein, 51 aa, Zea mays
  GRMZM2G067702_T01, SANT domain 118-168
RLVWTPQLHKRFVDVVAHLGIKKAVPKTIMELMNVEGLTRENVASHLQKYR

SEQ ID NO: 607 - protein, 51 aa, Setaria italica
  Si002653m, SANT domain 129-179
RLVWTPQLHKRFVDVVAHLGIKNAVPKTIMQLMNVEGLTRENVASHLQKYR

SEQ ID NO: 608 - protein, 51 aa, Arabidopsis thaliana; identical to SEQ ID NO: 607
  AT3G46640.3, SANT domain 146-196

SEQ ID NO: 609 - protein, 51 aa, Arabidopsis thaliana; identical to SEQ ID NO: 607
  AT5G59570.1, SANT domain 143-193

SEQ ID NO: 610 - protein, 51 aa, Citrus clementina; identical to SEQ ID NO: 607
  clementine0.9_013078m, SANT domain 158-208

SEQ ID NO: 611 - protein, 51 aa, Citrus clementina; identical to SEQ ID NO: 607
  clementine0.9_013095m, SANT domain 158-208

SEQ ID NO: 612 - protein, 51 aa, Citrus clementina; identical to SEQ ID NO: 607
  clementine0.9_013088m, SANT domain 158-208

SEQ ID NO: 613 - protein, 51 aa, Eucalyptus grandis; identical to SEQ ID NO: 607
  Eucgr.B02313.1, SANT domain 170-220

SEQ ID NO: 614 - protein, 51 aa, Populus trichocarpa
  POPTR_0001s25040.1, SANT domain 118-168
RLVWTPQLHKRFVDVVGHLGMKNAVPKTIMQWMNVEGLTRENVASHLQKYR

SEQ ID NO: 615 - protein, 51 aa, Populus trichocarpa
  POPTR_0009s03990.1, SANT domain 161-211
RLVWTPQLHKRFVDVVSHLGIKNAVPKTIMQLMNVEGLTRENVASHLQKYR

SEQ ID NO: 616 - protein, 51 aa, Populus trichocarpa; identical to SEQ ID NO: 615
  POPTR_0009s03990.2, SANT domain 133-183

SEQ ID NO: 617 - protein, 51 aa, Solanum lycopersicum; identical to SEQ ID NO: 607
  Solyc06g005680.2.1, SANT domain 148-198

SEQ ID NO: 618 - protein, 51 aa, Solanum lycopersicum
  Solyc06g076350.2.1, SANT domain 152-202
RLVWTPQLHKRFIEVVAHLGIKGAVPKTIMQLMNVEGLTRENVASHLQKYR

SEQ ID NO: 619 - protein, 51 aa, Glycine max; identical to SEQ ID NO: 607
  Glyma11g14490.1, SANT domain 146-196

SEQ ID NO: 620 - protein, 51 aa, Glycine max; identical to SEQ ID NO: 607
  Glyma11g14490.2, SANT domain 146-196

SEQ ID NO: 621 - protein, 51 aa, Glycine max; identical to SEQ ID NO: 607
  Glyma12g06410.1, SANT domain 145-195

SEQ ID NO: 622 - protein, 51 aa, Vitis vinifera
  GSVIVT01024916001, SANT domain 233-283
RLVWTPQLHKRFVDVVGHLGIKNAVPKTIMQLMNVEGLTRENVASHLQKYR

SEQ ID NO: 623 - protein, 84 aa, Arabidopsis thaliana
  AT1G33240, trihelix AKA GT domain 60-143
GNRWPREETLALLRIRSDMDSTFRDATLKAPLWEHVSRKLLELGYKRSSKKCKEKFENVQKYYKRTKETRGGRHDGKAYKFFSQ

SEQ ID NO: 624 - protein, 84 aa, Brachypodium distachyon
  Bradi5g17150.1, trihelix AKA GT domain 85-168
GNRWPREETLALIRIRSEMDATFRDATLKGPLWEEVSRKLAELGYKRNAKKCKEKFENVHKYYKRTKEGRTGRQDGKSYRFFSE

SEQ ID NO: 625 - protein, 84 aa, Zea mays
  GRMZM2G169580_T01, trihelix AKA GT domain 98-181
GNRWPREETLALIRIRTEMDADFRNAPLKAPLWEDVARKLAGLGYHRSAKKCKEKFENVHKYYKRTKDAHAGRQDGKSYRFFSQ

SEQ ID NO: 626 - protein, 84 aa, Brachypodium distachyon
  Bradi3g30457.1, trihelix AKA GT domain 86-169
GNRWPRQETLVLLKIRSDMDAAFRDATLKGPLWEEVSRKLAEEGYRRNAKKCKEKFENVHKYYKRTKDSRAGRNDGKTYRFFQQ

SEQ ID NO: 627 - protein, 84 aa, Setaria italica
  Si034382m, trihelix AKA GT domain 74-157
GNRWPRQETLALLKIRSEMDAAFREAALKGPLWEQVSRKLEAMGYKRSAKKCREKFENVDKYYKRTKDGRAGRGDGKAYRFFSE

SEQ ID NO: 628 - protein, 84 aa, Populus trichocarpa
  POPTR_0001s45870.1, trihelix AKA GT domain 104-187
GNRWPRQETLALLQIRSEMDAAFRDATLKGPLWEDVSRKLAEMGYKRSAKKCKEKFENVHKYYKRTKEGRAGRQDGKSYRFFSQ

SEQ ID NO: 629 - protein, 84 aa, Arabidopsis thaliana; identical to SEQ ID NO: 623
  AT1G33240.1, trihelix AKA GT domain 60-143

SEQ ID NO: 630 - protein, 84 aa, Populus trichocarpa
  POPTR_0005s21410.1, trihelix AKA GT domain 64-147
GSRWPRQETLALLKIRSGMDVAFRDASVKGPLWEEVSRKLAELGYNRSGKKCKEKFENVYKYHKRTKDGRTGKQEGKTYRFFDQ

SEQ ID NO: 631 - protein, 84 aa, Glycine max
  Glyma20g30640.1, trihelix AKA GT domain 63-146
GNRWPRQETLALLRIRSDMDVAFRDASVKGPLWEEVSRKMAELGYHRSSKKCKEKFENVYKYHKRTKEGRSGKQDGKTYRFFDQ

SEQ ID NO: 632 - protein, 84 aa, Solanum lycopersicum
  Solyc04g071360.2.1, trihelix AKA GT domain 58-141
GNRWPRQETIALLKIRSEMDVIFRDSSLKGPLWEEVSRKMADLGFHRSSKKCKEKFENVYKYHKRTKDGRASKADGKNYRFFEQ

SEQ ID NO: 633 - protein, 84 aa, Solanum lycopersicum
  Solyc12g056510.1.1, trihelix AKA GT domain 70-153
GNRWPRQETLALLKIRSEMDVVFKDSSLKGPLWEEVSRKLAELGYHRSAKKCKEKFENVYKYHRRTKDGRASKADGKTYRFFDQ

SEQ ID NO: 634 - protein, 85 aa, Populus trichocarpa
  POPTR_0001s31660.1, trihelix AKA GT domain 40-123
GNRWPKQETLALLKIRSDMDVAFKDSGLKAPLWEEVSKKLNELGYNRSAKKCKEKFENIYKYHRRTKEGRSGRPNGKTYRFFEQE

SEQ ID NO: 635 - protein, 84 aa, Populus trichocarpa
  POPTR_0019s02650.1, trihelix AKA GT domain 40-123
ANRWPKQETLALLEIRSDMDVAFRDSVVKAPLWEEVSRKLNELGYNRSAKKCKEKFENIYKYHRRTKGSQSGRPNGKTYRFFEQ

SEQ ID NO: 636 - protein, 84 aa, Solanum lycopersicum
  Solyc11g005380.1.1, trihelix AKA GT domain 52-135
GNRWPHEETLALLKIRSEMDVAFRDSNLKSPLWDEISRKMAELGYNRNAKKCREKFENIYKYHKRTKDGRSGRQTGKNYRFFEQ

SEQ ID NO: 637 - protein, 84 aa, Glycine max
  Glyma16g28240.1, trihelix AKA GT domain 53-136
GNRWPRQETLALLKIRSDMDTVFRDSSLKGPLWEEVSRKLAELGYQRSAKKCKEKFENVYKYNKRTKDNKSGKSHGKTYKFFDQ

SEQ ID NO: 638 - protein, 84 aa, Glycine max
  Glyma20g30650.1, trihelix AKA GT domain 66-149
GNRWPRQETLALLKIRSDMDAVFRDSSLKGPLWEEVARKLSELGYHRSAKKCKEKFENVYKYHKRTKESRSGKHEGKTYKFFDQ

SEQ ID NO: 639 - protein, 84 aa, Populus trichocarpa
  POPTR_0002s06900.1, trihelix AKA GT domain 58-141
ANRWPRQETLALLKIRSDMDAVFRDSGLKGPLWEEVSRKLAELGYHRSAKKCKEKFENVYKYHKRTKEGRTGKSEGKSYKFFDE

SEQ ID NO: 640 - protein, 84 aa, Populus trichocarpa
  POPTR_0005s21420.1, trihelix AKA GT domain 61-144
ANRWPRQETLALLKIRSAMDAVFRDSSLKGPLWEEVSRKLAELGYHRSAKKCKEKFENLYKYHKRTKEGRTGKSEGKTYKFFDE

SEQ ID NO: 641 - protein, 73 aa, Arabidopsis thaliana
  AT1G33240, trihelix AKA GT domain 187-259
SSRWPKAEILALINLRSGMEPRYQDNVPKGLLWEEISTSMKRMGYNRNAKRCKEKWENINKYYKKVKESNNSN

SEQ ID NO: 642 - protein, 85 aa, Brachypodium distachyon
  Bradi5g17150.1, trihelix AKA GT domain 496-580
SSRWPKTEVHALIQLRMDMDNRYQENGPKGPLWEEISSGMRRLGYNRNPKRCKEKWENINKYFKKVKESNKRRPEDSKTCPYFHQ

SEQ ID NO: 643 - protein, 85 aa, Zea mays
  GRMZM2G169580_T01, trihelix AKA GT domain 411-495
SSRWPKEEVEALIQVRNEKDEQYHDAGGKGPLWEDIAAGMRRIGYNRSAKRCKEKWENINKYYKKVKESNKRRPEDSKTCPYFHQ

SEQ ID NO: 644 - protein, 85 aa, Brachypodium distachyon
  Bradi3g30457.1, trihelix AKA GT domain 453-537
SSRWPKAEVHALIQLRSNLDTRYQEAGPKGPLWEEISAGMRRMGYSRSSKRCKEKWENINKYFKKVKESNKKRPEDSKTCPYFHQ

SEQ ID NO: 645 - protein, 85 aa, Setaria italica
  Si034382m, trihelix AKA GT domain 458-542
PSRWPKAEVHALIQLRTELEARYQDSGPKGPLWEDISAGMRRLGYNRSAKRCKEKWENINKYFKKVKESNKKRPEDSKTCPYYHQ

SEQ ID NO: 646 - protein, 85 aa, Populus trichocarpa
  POPTR_0001s45870.1, trihelix AKA GT domain 520-604
SSRWPKPEVLALIKLRSGLETRYQEAGPKGPLWEEISAGMLRLGYKRSSKRCKEKWENINKYFKKVKESNKKRTEDAKTCPYFHE

SEQ ID NO: 647 - protein, 85 aa, Arabidopsis thaliana
  AT1G33240.1, trihelix AKA GT domain 433-517
SSRWPKAEILALINLRSGMEPRYQDNVPKGLLWEEISTSMKRMGYNRNAKRCKEKWENINKYYKKVKESNKKRPQDAKTCPYFHR

SEQ ID NO: 648 - protein, 85 aa, Populus trichocarpa
  POPTR_0005s21410.1, trihelix AKA GT domain 404-488
PSRWPKVEVEALIRIRTNLDCKYQDNGPKGPLWEEISARMRKLGYNRNAKRCKEKWENINKYFKKVKESKKKRPEDSKTCPYFQQ

SEQ ID NO: 649 - protein, 85 aa, Glycine max
  Glyma20g30640.1, trihelix AKA GT domain 457-541
SSRWPKVEVQALIKLRTSMDEKYQENGPKGPLWEEISASMKKLGYNRNAKRCKEKWENINKYFKKVKESNKRRPEDSKTCPYFHQ

SEQ ID NO: 650 - protein, 85 aa, Solanum lycopersicum
  Solyc04g071360.2.1, trihelix AKA GT domain 459-543
SSRWPKAEVEALIKLRTNLDVKYQENGPKGPLWEEISSGMKKIGYNRNAKRCKEKWENINKYFKKVKESNKKRPEDSKTCPYFHQ

SEQ ID NO: 651 - protein, 85 aa, Solanum lycopersicum
  Solyc12g056510.1.1, trihelix AKA GT domain 455-539
SSRWPKEEIEALISLRTCLDLKYQENGPKGPLWEEISSGMRKIGYNRNAKRCKEKWENINKYFKKVKESNKKRPEDSKTCPYFHQ

SEQ ID NO: 652 - protein, 85 aa, Populus trichocarpa
  POPTR_0001s31660.1, trihelix AKA GT domain 337-421
PSRWPKEEIEALIGLRTKLEFQYEENGPKGPLWEEISASMKKLGYDRSAKRCKEKWENMNKYFKRVKESNKRRPGDSKTCPYFQQ

SEQ ID NO: 653 - protein, 85 aa, Populus trichocarpa
  POPTR_0019s02650.1, trihelix AKA GT domain 331-415
SSRWPKEEIESLIKIRTYLEFQYQENGPKGPLWEEISTSMKNLGYDRSAKRCKEKWENMNKYFKRVKDSNKKRPGDSKTCPYFQQ

SEQ ID NO: 654 - protein, 86 aa, Solanum lycopersicum
  Solyc11g005380.1.1, trihelix AKA GT domain 363-448
SSRWPKAEVEALIKLRTNVDLQYQDNGSSKGPLWEDISCGMKKLGYDRNAKRCKEKWENINKYYRRVKESQKKRPEDSKTCPYFHQ

SEQ ID NO: 655 - protein, 85 aa, Glycine max
  Glyma16g28240.1, trihelix AKA GT domain 412-496
SSRWPKAEVHALIRIRTSLETKYQENGPKAPLWEDISIAMQRLGYNRSAKRCKEKWENINKYFKRVRESSKERREDSKTCPYFHE

SEQ ID NO: 656 - protein, 85 aa, Glycine max
  Glyma20g30650.1, trihelix AKA GT domain 442-526
SSRWPKTEVHALIRLRTSLEAKYQENGPKAPFWEDISAGMLRLGYNRSAKRCKEKWENINKYFKKVKESNKQRREDSKTCPYFHE

SEQ ID NO: 657 - protein, 85 aa, Populus trichocarpa
  POPTR_0002s06900.1, trihelix AKA GT domain 405-489
SSRWPKVEVQALINLRANLDVKYQENGAKGPLWEDISAGMQKLGYNRSAKRCKEKWENINKYFKKVKESNKKRPEDSKTCPYFDQ

SEQ ID NO: 658 - protein, 85 aa, Populus trichocarpa
  POPTR_0005s21420.1, trihelix AKA GT domain 406-490
SSRWPKVEVQALISLRADLDIKYQEHGAKGPLWEDISAGMQKLGYNRSAKRCKEKWENINKYFKKVKESNRKRPGDSKTCPYFDQ

SEQ ID NO: 659 - protein, 58 aa, Arabidopsis thaliana
  AT2G40350, AP2 domain 72-129
CDYTGVRQRTWGKWVAEIREPGRGAKLWLGTFSSSYEAALAYDEASKAIYGQSARLNL

SEQ ID NO: 660 - protein, 57 aa, Brachypodium distachyon
  Bradi2g04000.1, AP2 domain 76-133
CAYRGVRQRTWGKWVAEIREPNRGKRLWLGSFPTAVEAAHAYDEAARAMYGAKARVN

SEQ ID NO: 661 - protein, 58 aa, Oryza sativa
  LOC_Os01g07120.1, AP2 domain 81-138
CAYRGVRQRTWGKWVAEIREPNRGRRLWLGSFPTALEAAHAYDEAARAMYGPTARVNF

SEQ ID NO: 662 - protein, 58 aa, Setaria italica
  Si002067m, AP2 domain 167-224
CPYRGVRQRTWGKWVAEIREPNRGKRLWLGSFPTAVEAAHAYDEAAKAMYGPKARVNF

SEQ ID NO: 663 - protein, 58 aa, Brachypodium distachyon
  Bradi2g29960.1, AP2 domain 130-187
CKFRGVRQRTWGKWVAEIREPNRVSRLWLGTFPTAETAACAYDEAARAMYGPLARTNF

SEQ ID NO: 664 - protein, 58 aa, Setaria italica
  Si022619m, AP2 domain 83-140
CGYRGVRQRTWGKWVAEIREPNRANRLWLGTFPTAEDAARAYDQAARAMYGEVARTNF

SEQ ID NO: 665 - protein, 58 aa, Setaria italica; identical to SEQ ID NO: 664
  Si022621m, AP2 domain 82-139

SEQ ID NO: 666 - protein, 58 aa, Eucalyptus grandis
  Eucgr.G03094.1, AP2 domain 69-126
FNYRGVRQRTWGKWVAEIREPNRGSRLWLGTFPTAIEAAKAYDEAATAMYGPCARLNF

SEQ ID NO: 667 - protein, 58 aa, Glycine max
  Glyma06g45680.1, AP2 domain 65-122
CNYRGVRQRTWGKWVAEIREPNRGSRLWLGTFPTAISAALAYDEAARAMYGSCARLNF

SEQ ID NO: 668 - protein, 58 aa, Glycine max
  Glyma12g11150.1, AP2 domain 65-122
CNYRGVRQRTWGKWVAEIREPNRGSRLWLGTFPTAISAALAYDEAAMAMYGFCARLNF

SEQ ID NO: 669 - protein, 58 aa, Glycine max
  Glyma12g32400.1, AP2 domain 63-120
CNYRGVRQRTWGKWVAEIREPNRGNRLWLGTFPTAIGAALAYDEAARAMYGSCARLNF

SEQ ID NO: 670 - protein, 59 aa, Glycine max
  Glyma13g38030.1, AP2 domain 63-120
CNYRGVRQRTWGKWVAEIREPNRGNRLWLGTFPTAIGAALAYDEAARAMYGSCARLNFP

SEQ ID NO: 671 - protein, 58 aa, Arabidopsis thaliana
  AT2G40340.1, AP2 domain 70-127
CDYRGVRQRRWGKWVAEIREPDGGARLWLGTFSSSYEAALAYDEAAKAIYGQSARLNL

SEQ ID NO: 672 - protein, 58 aa, Arabidopsis thaliana; identical to SEQ ID NO: 659
  AT2G40350.1, G1755, AP2 domain 65-122

SEQ ID NO: 673 - protein, 65 aa, Glycine max
  Glyma07g19220.1, AP2 domain 65-129
CKFRGVRQRIWGKWVAEIREPINGKLVGEKANRLWLGTFSTALEAALAYDEAAKAMYGPCARLNF

SEQ ID NO: 674 - protein, 65 aa, Glycine max
  Glyma18g43750.1, AP2 domain 65-129
CKFRGVRQRIWGKWVAEIREPINGKLVGEKANRLWLGTFSTALEAALAYDEAAKALYGPCARLNF

SEQ ID NO: 675 - protein, 58 aa, Glycine max
  Glyma02g42960.1, AP2 domain 78-135
CNYRGVRQRTWGKWVGEIREPNRGSRLWLGTFSSAQEAALAYDEAARAMYGPCARLNF

SEQ ID NO: 676 - protein, 58 aa, Glycine max; identical to SEQ ID NO: 675
  Glyma14g06080.1, AP2 domain 78-135

SEQ ID NO: 677 - protein, 58 aa, Populus trichocarpa
  POPTR_0008s07360.1, AP2 domain 78-135
CNYRGVRQRTWGKWVAEIREPNRGPRLWLGTFPTAYEAALAYDNAARAMYGSCARLNI

SEQ ID NO: 678 - protein, 58 aa, Populus trichocarpa
  POPTR_0010s19100.1, AP2 domain 78-135
CNYRGVRQRTWGKWVAEIREPNRGPRLWLGTFPTAYEAALAYDEAARAMYGPYARLNV

SEQ ID NO: 679 - protein, 58 aa, Solanum lycopersicum
  Solyc05g052410.1.1, AP2 domain 72-129
CKYRGVRQRTWGKWVAEIREPHRGRRLWLGTFDTAIEAALAYDEAARAMYGPCARLNL

SEQ ID NO: 680 - protein, 58 aa, Solanum lycopersicum
  Solyc06g050520.1.1, AP2 domain 80-137
CKYRGVRQRIWGKWVAEIREPKRGSRLWLGTFGTAIEAALAYDDAARAMYGPCARLNL

SEQ ID NO: 681 - protein, 64 aa, Zea mays
  GRMZM2G047999_T01, AP2 domain 73-136
RYLGVRRRPWGRYAAEIRDPATKERHWLGTFDTAEEAAIAYDRAARNIRGANARTNFAYPDLPP

SEQ ID NO: 682 - protein, 64 aa, Oryza sativa
  LOC_Os02g32040.1, AP2 domain 39-102
RYLGVRRRPWGRYAAEIRDPATKERHWLGTFDTAEEAAVAYDRAARTIRGAAARTNFAYPDLPP

SEQ ID NO: 683 - protein, 64 aa, Oryza sativa
  LOC_Os04g32790.1, AP2 domain 51-114
RYLGVRRRPWGRYAAEIRDPATKERHWLGTFDTAEEAAVAYDRAARSLRGARARTNFAYPDLPP

SEQ ID NO: 684 - protein, 64 aa, Zea mays; identical to SEQ ID NO: 683
  GRMZM2G023708_T01, AP2 domain 41-104

SEQ ID NO: 685 - protein, 64 aa, Zea mays; identical to SEQ ID NO: 683
  GRMZM2G079825_T01, AP2 domain 37-100

SEQ ID NO: 686 - protein, 64 aa, Arabidopsis thaliana
  AT1G28160.1, AP2 domain 38-101
KYVGVRRRPWGRYAAEIRNPTTKERYWLGTFDTAEEAALAYDRAARSIRGLTARTNFVYSDMPR

SEQ ID NO: 687 - protein, 64 aa, Eucalyptus grandis
  Eucgr.B03565.1, AP2 domain 46-109
RFLGVRRRPWGRYAAEIRDPTTKERHWLGTFDTAEEAALAYDRAARSMRGAKARTNFVYSDMPP

SEQ ID NO: 688 - protein, 64 aa, Populus trichocarpa
  POPTR_0001s12820.1, AP2 domain 37-100
RFLGVRRRPWGRYAAEIRDPSTKERHWLGTFDTAEEAALAYDRAARSMRGSKARTNFVYSDMPP

SEQ ID NO: 689 - protein, 64 aa, Populus trichocarpa; identical to SEQ ID NO: 688
  POPTR_0003s15940.1, AP2 domain 39-102

SEQ ID NO: 690 - protein, 64 aa, Arabidopsis thaliana
  AT5G13910.1, AP2 domain 19-82
RFLGVRRRPWGRYAAEIRDPTTKERHWLGTFDTAEEAALAYDRAARSMRGTRARTNFVYSDMPP

SEQ ID NO: 691 - protein, 64 aa, Populus trichocarpa
  POPTR_0001s15710.1, AP2 domain 25-88
RFLGVRRRPWGRYAAEIRDPSTKERHWLGTFDTAEEAALAYDRAARSMRGSRARTNFVYSDMPA

SEQ ID NO: 692 - protein, 64 aa, Populus trichocarpa
  POPTR_0003s07540.1, AP2 domain 25-88
RFLGVRRRPWGRYAAEIRDPSTKERHWLGTFDTAEEAALAYDRAARSMRGPRARTNFVYSDMPA

SEQ ID NO: 693 - protein, 64 aa, Eucalyptus grandis
  Eucgr.I01576.1, AP2 domain 27-90
RFLGVRRRPWGRYAAEIRDPSTKERHWLGTFDTAEEAALAYDRAARSMRGSRARTNFVYSDLPA

SEQ ID NO: 694 - protein, 64 aa, Glycine max
  Glyma02g07460.1, AP2 domain 31-94
RYLGVRRRPWGRYAAEIRDPSTKERHWLGTFDTAEEAALAYDRAARSMRGSRARTNFVYPDTPP

SEQ ID NO: 695 - protein, 64 aa, Glycine max
  Glyma16g26460.1, AP2 domain 31-94
RYLGVRRRPWGRYAAEIRDPSTKERHWLGTFDTAEEAALAYDKAARSMRGSRARTNFIYPDTPP

SEQ ID NO: 696 - protein, 64 aa, Vitis vinifera
  GSVIVT01032961001, AP2 domain 21-84
RFLGVRRRPWGRYAAEIRDPSTKERHWLGTFDTAEEAALAYDRAARSMRGSRARTNFVYSDMPP

SEQ ID NO: 697 - protein, 64 aa, Glycine max
  Glyma16g05070.1, AP2 domain 14-77
RYLGVRRRPWGRYAAEIRDPSTKERHWLGTFDTADEAALAYDRAARAMRGSRARTNFVYADTTP

SEQ ID NO: 698 - protein, 38 aa, Brachypodium distachyon
  Bradi4g35950.1, 1st B-box domain 5-42
CDVCESAVAVLFCAADEAALCRSCDEKVHLCNKLASRH

SEQ ID NO: 699 - protein, 38 aa, Oryza sativa
  LOC_Os09g35880.1, 1st B-box domain 5-42
CDVCESAPAVLFCVADEAALCRSCDEKVHMCNKLARRH

SEQ ID NO: 700 - protein, 38 aa, Zea mays
  GRMZM2G143718_T01, 1st B-box domain 5-42
CDVCESAPAVLFCAADEAALCRPCDEKVHMCNKLASRH

SEQ ID NO: 701 - protein, 38 aa, Zea mays; identical to SEQ ID NO: 700
  GRMZM2G422644_T01, 1st B-box domain 5-42

SEQ ID NO: 702 - protein, 38 aa, Arabidopsis thaliana
  AT2G21320.1, 1st B-box domain 5-42
CDACESAAAIVFCAADEAALCCSCDEKVHKCNKLASRH

SEQ ID NO: 703 - protein, 38 aa, Arabidopsis thaliana
  AT4G38960.1, 1st B-box domain 5-42
CDACENAAAIIFCAADEAALCRPCDEKVHMCNKLASRH

SEQ ID NO: 704 - protein, 38 aa, Eucalyptus grandis
  Eucgr.I02368.1, 1st B-box domain 5-42
CDACESAAAVVFCAADEAALCSACDDKVHMCNKLASRH

SEQ ID NO: 705 - protein, 38 aa, Glycine max
  Glyma01g37370.1, 1st B-box domain 5-42
CDACESAAAIVFCAADEAALCRACDEKVHMCNKLASRH

SEQ ID NO: 706 - protein, 38 aa, Glycine max; identical to SEQ ID NO: 705
  Glyma11g07930.1, B-box domain 5-42

SEQ ID NO: 707 - protein, 38 aa, Populus trichocarpa
  POPTR_0005s11900.1, 1st B-box domain 5-42
CDACESAFAIVFCAADEAALCLACDKKVHMCNKLASRH

SEQ ID NO: 708 - protein, 38 aa, Populus trichocarpa
  POPTR_0007s13830.1, 1st B-box domain 5-42
CDACESAAAIVFCAADEAALCLACDEKVHMCNKLASRH

SEQ ID NO: 709 - protein, 38 aa, Vitis vinifera
  GSVIVT01018818001, 1st B-box domain 5-42
CDVCESAAAILFCAADEAALCRVCDEKVHMCNKLASRH

SEQ ID NO: 710 - protein, 38 aa, Eucalyptus grandis
  Eucgr.I01328.1, 1st B-box domain 5-42
CDVCENAAAIFFCAADEAALCRACDEKVHLCNKLASRH

SEQ ID NO: 711 - protein, 38 aa, Populus trichocarpa
  POPTR_0004s16950.1, 1st B-box domain 5-42
CDVCESAAAILFCAADEAALCRSCDEKVHMCNKLASRH

SEQ ID NO: 712 - protein, 38 aa, Populus trichocarpa
  POPTR_0009s12730.1, 1st B-box domain 5-42
CDVCESAAAILFCAADEAALCRSCDEKVHLCNKLASRH

SEQ ID NO: 713 - protein, 38 aa, Vitis vinifera
  GSVIVT01024173001, 1st B-box domain 5-42
CDACESAAAILFCAADEAALCRACDEKVHMCNKLASRH

SEQ ID NO: 714 - protein, 38 aa, Solanum lycopersicum; identical to SEQ ID NO: 712
  Solyc01g110370.2.1, 1st B-box domain 5-42

SEQ ID NO: 715 - protein, 38 aa, Glycine max
  Glyma11g11850.1, 1st B-box domain 5-42
CDVCESAAAILFCAADEAALCSACDHKIHMCNKLASRH

SEQ ID NO: 716 - protein, 38 aa, Glycine max
  Glyma12g04130.1, 1st B-box domain 5-42
CDVCESAAAIVFCAADEAALCSACDHKIHMCNKLASRH

SEQ ID NO: 717 - protein, 36 aa, Brachypodium distachyon
  Bradi4g35950.1, 2nd B-box domain 56-91
CDICENSPAFFYCDIDGTSLCLSCDMAVHVGGKRTH

SEQ ID NO: 718 - protein, 36 aa, Oryza sativa
  LOC_Os09g35880.1, 2nd B-box domain 56-91
CDICENAPAFFYCEIDGTSLCLSCDMTVHVGGKRTH

SEQ ID NO: 719 - protein, 36 aa, Zea mays
  GRMZM2G143718_T01, 2nd B-box domain 56-91
CDICENSPAFFYCEIDGTSLCLSCDMTVHVGGKRTH

SEQ ID NO: 720 - protein, 36 aa, Zea mays; identical to SEQ ID NO: 719
  GRMZM2G422644_T01, 2nd B-box domain 56-91

SEQ ID NO: 721 - protein, 36 aa, Arabidopsis thaliana
  AT2G21320.1, 2nd B-box domain 56-91
CDICENAPAFFYCEIDGSSLCLQCDMVVHVGGKRTH

SEQ ID NO: 722 - protein, 36 aa, Arabidopsis thaliana; identical to SEQ ID NO: 721
  AT4G38960.1, B-box 2nd domain 56-91

SEQ ID NO: 723 - protein, 36 aa, Eucalyptus grandis
  Eucgr.I02368.1, 2nd B-box domain 56-91
CDICENAPAFFYCEVDGTSLCLQCDMIVHVGGKRTH

SEQ ID NO: 724 - protein, 36 aa, Glycine max
  Glyma01g37370.1, 2nd B-box domain 56-91
CDICENAPAFFYCETDGSSLCLQCDMIVHVGGKRTH

SEQ ID NO: 725 - protein, 36 aa, Glycine max; identical to SEQ ID NO: 724
  Glyma11g07930.1, 2nd B-box domain 56-91

SEQ ID NO: 726 - protein, 36 aa, Populus trichocarpa
  POPTR_0005s11900.1, 2nd B-box domain 56-91
CDICENAPAFFYCETDGSSLCLQCDMTVHVGGKRTH

SEQ ID NO: 727 - protein, 36 aa, Populus trichocarpa; identical to SEQ ID NO: 726
  POPTR_0007s13830.1, 2nd B-box domain 56-91

SEQ ID NO: 728 - protein, 36 aa, Vitis vinifera
  GSVIVT01018818001, 2nd B-box domain 56-91
CDICENAPAFFYCEIDGTSLCLQCDMIVHVGGKRTH

SEQ ID NO: 729 - protein, 36 aa, Eucalyptus grandis
  Eucgr.I01328.1, 2nd B-box domain 56-91
CDICENAPAFFYCEIDGSSLCLQCDMLVHVGGKRTH

SEQ ID NO: 730 - protein, 36 aa, Populus trichocarpa
  POPTR_0004s16950.1, 2nd B-box domain 56-91
CDICEKAPAFFYCEIDGSSLCLQCDMIVHVGGKRTH

SEQ ID NO: 731 - protein, 36 aa, Populus trichocarpa
  POPTR_0009s12730.1, 2nd B-box domain 56-91
CDICENAPAFFYCEIDGSSLCLQCDMIVHVGGKRTH

SEQ ID NO: 732 - protein, 36 aa, Vitis vinifera; identical to SEQ ID NO: 723
  GSVIVT01024173001, 2nd B-box domain 56-91

SEQ ID NO: 733 - protein, 36 aa, Solanum lycopersicum; identical to SEQ ID NO: 731
  Solyc01g110370.2.1, 2nd B-box domain 56-91

SEQ ID NO: 734 - protein, 36 aa, Glycine max; identical to SEQ ID NO: 731
  Glyma11g11850.1, 2nd B-box domain 56-91

SEQ ID NO: 735 - protein, 36 aa, Glycine max; identical to SEQ ID NO: 731
  Glyma12g04130.1, 2nd B-box domain 56-91

SEQ ID NO: 736 - protein, 58 aa, Brachypodium distachyon
  Bradi1g35990.1, bHLH domain 145-202
RGQATDSHSLAERARREKINARMELLKELVPGCSKVSGTALVLDEIINHVQSLQRQVE

SEQ ID NO: 737 - protein, 58 aa, Zea mays; identical to SEQ ID NO: 736
  GRMZM2G074438_T01, bHLH domain 161-218

SEQ ID NO: 738 - protein, 58 aa, Zea mays; identical to SEQ ID NO: 736
  GRMZM2G378653_T01, bHLH domain 184-241

SEQ ID NO: 739 - protein, 58 aa, Setaria italica; identical to SEQ ID NO: 736
  Si006781m, bHLH domain 177-234

SEQ ID NO: 740 - protein, 58 aa, Arabidopsis thaliana
  AT2G42300.1, bHLH domain 189-246
RGQATDNHSLAERARREKINARMKLLQELVPGCDKIQGTALVLDEIINHVQTLQRQVE

SEQ ID NO: 741 - protein, 58 aa, Arabidopsis thaliana
  AT3G57800.2, bHLH domain 208-265
RGQATDSHSLAERARREKINARMKLLQELVPGCDKIQGTALVLDEIINHVQSLQRQVE

SEQ ID NO: 742 - protein, 58 aa, Eucalyptus grandis
  Eucgr.A02413.1, bHLH domain 185-242
RGQATDSHSLAERARREKINARMKLLQELVPGCSKISGTASVLDEIINHVQSLQRQVE

SEQ ID NO: 743 - protein, 58 aa, Glycine max
  Glyma03g29710.1, bHLH domain 210-267
RGQATDSHSLAERARREKINARMKLLQELVPGCDKISGTAMVLDEIINHVQSLQRQVE

SEQ ID NO: 744 - protein, 58 aa, Glycine max; identical to SEQ ID NO: 743
  Glyma19g32570.1, bHLH domain 204-261

SEQ ID NO: 745 - protein, 58 aa, Glycine max
  Glyma10g12210.1, bHLH domain 196-253
RGQATDSHSLAERARREKINARMKLLQELVPGCNKISGTALVLDKIINHVQSLQNEVE

SEQ ID NO: 746 - protein, 58 aa, Citrus clementina
  clementine0.9_011877m, bHLH domain 242-299
RGQATDSHSLAERARREKINARMKLLQELVPGCNKISGTALVLDEIINHVQSLQRQVE

SEQ ID NO: 747 - protein, 58 aa, Citrus clementina; identical to SEQ ID NO: 746
  clementine0.9_015567m, bHLH domain 242-299

SEQ ID NO: 748 - protein, 58 aa, Populus trichocarpa
  POPTR_0006s05600.1, bHLH domain 181-238
RGQATDSHSLAERARREKINQRMKLLQELVPGCNKISGTALVLDEIINHVQSLQCQVE

SEQ ID NO: 749 - protein, 58 aa, Vitis vinifera
  GSVIVT01033350001, bHLH domain 201-258
RGQATDSHSLAERARREKINARMKLLQELVPGCNKISGTALVLDEIISHVQSLQRQVE

SEQ ID NO: 750 - protein, 58 aa, Solanum lycopersicum
  Solyc10g079070.1.1, bHLH domain 198-255
RGQATDSHSLAERARREKINARMKLLQELVPGCNKISGTAMVLDEIINHVQSLQRQVE

SEQ ID NO: 751 - protein, 65 aa, Brachypodium distachyon
  Bradi3g17790.1, NF-Y_histone-like domain 77-141
HSLPLARIKKIMKADEDVQMIAGEAPAVFAKACEMFILELTLRSWLQTRENNRNTLQKNDIATVV

SEQ ID NO: 752 - protein, 66 aa, Brachypodium distachyon
  Bradi3g17800.1, NF-Y_histone-like domain 240-305
HSLPLARIKKIMKASGENVQMIAGEAHGLLAKACEIFIQELTLRSWLQTRENNRRTLQKNDIAAAV

SEQ ID NO: 753 - protein, 66 aa, Brachypodium distachyon
  Bradi3g17820.1, NF-Y_histone-like domain 7-72
HSLPLERIKKIMKASGENVQVIAGEAPGVLTKACEIFIQELTLRSWLQTREKNRRTLQKNDIAAAV

SEQ ID NO: 754 - protein, 66 aa, Brachypodium distachyon
  Bradi3g17810.1, NF-Y_histone-like domain 99-164
HSLPLARIKKIMKASGEDIRMIASEAPGLLAKASEIFIQELTLRSWLETRDNNRRTLQKNDIGAAV

SEQ ID NO: 755 - protein, 65 aa, Oryza sativa
  LOC_Os08g10560.1, NF-Y_histone-like domain 380-444
PNLPLARIKKIMKADEDVKMIAGEAPALFAKACEMFILDMTLRSWQHTEEGRRRTLQRSDVEAVI

SEQ ID NO: 756 - protein, 65 aa, Setaria italica
  Si015775m, NF-Y_histone-like domain 55-119
HSLPLARIKKIMKADEDVKMIAAEAPVVFAKACEMFILELTLRSWLHTEGTKRRTMQRSDVSAAI

SEQ ID NO: 757 - protein, 65 aa, Arabidopsis thaliana
  AT5G27910.1, NF-Y_histone-like domain 35-99
HDLPITRIKKIMKYDPDVTMIASEAPILLSKACEMFIMDLTMRSWLHAQESKRVTLQKSNVDAAV

SEQ ID NO: 758 - protein, 65 aa, Arabidopsis thaliana
  AT5G50490.1, NF-Y_histone-like domain 35-99
HEFPISRIKRIMKFDPDVSMIAAEAPNLLSKACEMFVMDLTMRSWLHAQESNRLTIRKSDVDAVV

SEQ ID NO: 759 - protein, 71 aa, Arabidopsis thaliana
  AT5G50470.1, NF-Y_histone-like domain 62-132
HAFPLTRIKKIMKSNPEVNMVTAEAPVLISKACEMLILDLTMRSWLHTVEGGRQTLKRSDTLTRSDISAAT

SEQ ID NO: 760 - protein, 65 aa, Arabidopsis thaliana
  AT5G50480.1, NF-Y_histone-like domain 53-117
RQLPLARIKKIMKADPDVHMVSAEAPIIFAKACEMFIVDLTMRSWLKAEENKRHTLQKSDISNAV

SEQ ID NO: 761 - protein, 66 aa, Solanum lycopersicum
  Solyc00g107050.1.1, NF-Y_histone-like domain 55-120
NLLVSPNRIKNIMKTNKDVRRITSESPVLLAKACDFFIQELTLRSWLNAQENHRRILKKKDVTDVI

SEQ ID NO: 762 - protein, 66 aa, Solanum lycopersicum
  Solyc02g021330.1.1, NF-Y_histone-like domain 54-119
NHLLPPNLIKKLMKTDEDDQMIAAESPVLLAKTCELFIQELTLRSWLNAQEKHQHILKKDDVTDVI

SEQ ID NO: 763 - protein, 66 aa, Solanum lycopersicum
  Solyc03g110840.1.1, NF-Y_histone-like domain 52-117
RLLLPPTRIKKIMKKNEDVRMVAGESPVLLAKACELFIQDLTLRSSIHAQENHRRILKKDDLTDVI

SEQ ID NO: 764 - protein, 66 aa, Solanum lycopersicum
  Solyc03g110850.1.1, NF-Y_histone-like domain 53-118
NLLPRIHRIKKIMKTDKDVRMIATESPVLLAKACELFIQELTLRSWFKAEENHRRILKKDDVTDVI

SEQ ID NO: 765 - protein, 66 aa, Solanum lycopersicum
  Solyc11g016920.1.1, NF-Y_histone-like domain 53-118
NLLPSINRIKKIMKTDKDVRMIATESPVLLAKACELFIQELTLRSWFKTEKNHRRILKKDDVTDVI

SEQ ID NO: 766 - protein, 65 aa, Solanum lycopersicum
  Solyc03g111460.1.1, NF-Y_histone-like domain 64-128
HSLPISRIKKIMKSDKEVRMISAESPILLAKACELFIQELTHRSWLKAQECQRQTLKKIDLFTVL

SEQ ID NO: 767 - protein, 65 aa, Solanum lycopersicum
  Solyc03g111470.1.1, NF-Y_histone-like domain 74-138
HSLPIFRIKKIMKSDKEVRMISAESPILLDKACELFIQELTHRSWLKAQECQRRTLKKIDFFTTE

SEQ ID NO: 768 - protein, 65 aa, Solanum lycopersicum
  Solyc03g111450.1.1, NF-Y_histone-like domain 102-166
HHFPISRIKRIIKSENNAIKLSAETPILFSKACELFVLELTLRSWFHAQQNNRGSLKKTDFAAAI

SEQ ID NO: 769 - protein, 37 aa, Arabidopsis thaliana
  AT1G60250.1, B-box BBX domain 5-41
CHTCRHVTAVIHCVTEALNFCLTCDNLRHHNNIHAEH

SEQ ID NO: 770 - protein, 38 aa, Arabidopsis thaliana
  AT1G68190.1, BBX domain 14-51
CEFCKAYRAVVYCIADTANLCLTCDAKVHSANSLSGRH

SEQ ID NO: 771 - protein, 38 aa, Populus trichocarpa
  POPTR_0008s12410.1, BBX domain 5-42
CEFCMALRPVVYCNADAAYLCLSCDAKVHSANALFNRH

SEQ ID NO: 772 - protein, 38 aa, Glycine max
  Glyma10g41540.1, BBX domain 5-42
CEFCTALRPLVYCKADAAYLCLSCDAKVHLANAVSGRH

SEQ ID NO: 773 - protein, 38 aa, Glycine max
  Glyma20g25700.1, BBX domain 5-42
CEFCTALRPLVYCKADAAYLCLSCDSKVHLANAVSGRH

SEQ ID NO: 774 - protein, 38 aa, Solanum lycopersicum
  Solyc04g007470.2, BBX domain 7-44
CEFCMLLKPVVYCEADAAHLCLSCDAKVHSANALSNRH

SEQ ID NO: 775 - protein, 219 aa, Brachypodium distachyon
  Bradi2g57087.1 methyltransferase domain coordinates 394-612
VILDVGCGVASFGGYMFDRDVLTMSFAPKDEHEAQVQFALERGIPAISAVMGTKRLPYPSRVFDVIHCARCRVPWHIEGGKLLLELNRLLRPGGYFVWSATPVYQKLPEDVEIWNAMSSLTKSMCWKMVKKTKDTLNQVGMAIYQKPMDNNCYEKRSEDSPPLCKETDDADASWNITLQACIHKLPVGPSVRGSKWPEFWPQRLEKTPFWIDGSHVGVY

SEQ ID NO: 776 - protein, 219 aa, Oryza sativa
  LOC_Os01g66110.1 methyltransferase domain coordinates 406-624
VILDVGCGVASFGGYMFERDVLTMSFAPKDEHEAQVQFALERGIPAISAVMGTKRLPYPSRVFDVIHCARCRVPWHIEGGMLLLELNRLLRPGGYFVWSATPVYQKLPEDVEIWNAMSSLTKAMCWKMVNKTKDKLNQVGMAIYQKPMDNSCYEKRPENSPPLCKETDDADAAWNVPLQACMHKLPAGQSVRGSKWPETWPQRLEKTPYWIDDSHVGIY

SEQ ID NO: 777 - protein, 219 aa, Zea mays
  GRMZM2G049269_T01 methyltransferase domain coordinates 392-610
VILDVGCGVASFGGYMFDRDALTMSFAPKDEHEAQVQFALERGIPAISAVMGTKRLPYPSRVFDVIHCARCRVPWHIEGGMLLLELNRLLRPGGYFVWSATPVYQKLPEDVEIWNAMSTLTKSMCWKMVNKTKDKLNQVGMVIYQKPMDNICYEKRSENSPPLCKESDDADAAWNVPLEACMHKLPGGSKVRGSKWPELWPQRLEKTPFWIDGSKVGVY

SEQ ID NO: 778 - protein, 219 aa, Setaria italica
  Si000354m methyltransferase domain coordinates 397-615
VILDVGCGVASFGGYMFDRDVLTMSFAPKDEHEAQVQFALERGIPAISAVMGTKRLPYPSRVFDVIHCARCRVPWHIEGGMLLLELNRLLRPGGYFVWSATPVYQKLPEDVEIWNAMSALTKSMCWKMVNKTKDKLNQVGMAIYQKPMDNNCYEKRSENNPPLCKDSDDADAAWNVPLEACMHKLPAGPTVRGAKWPESWPQRLEKTPFWLNGSQVGVY

SEQ ID NO: 779 - protein, 219 aa, Brachypodium distachyon
  Bradi5g27590.1 methyltransferase domain coordinates 319-537
VVLDVGCGVASFGGYLFDRDVLTMSFAPKDEHEAQVQFALERGIPAISAVMGTKRLPFPGRVFDAVHCARCRVPWHIEGGKLLLELDRLLRPGGYFVWSATPAYQKLPEDVEIWQAMSALTRSMCWKMVNKVKDRLNRVGVAIFQKPIDNRCYDGRSAANLPLCGEYDNVDAAWNVSLESCIHKLPVDPAIRSSRWPEEWPLRLERAPYWLKSSEPGVY

SEQ ID NO: 780 - protein, 219 aa, Oryza sativa
  LOC_Os04g59590.1 methyltransferase domain coordinates 275-493
VVLDVGCGVASFGGYLFDRDVLTMSFAPKDEHEAQVQFALERGIPAMSAVMGTKRLPFPGRVFDVVHCARCRVPWHIEGGKLLLELDRLLRPGGYFVWSATPVYQKLPEDVEIWEAMSTLTRSMCWEMVNKVKDRVNRVGIAIFRKPTDNSCYEARSAANPPICGEYDDPDAAWNISLQSCVHRLPTDPAIRGSQWPVEWPLRLEKPPYWLKNSEAGVY

SEQ ID NO: 781 - protein, 219 aa, Zea mays
  GRMZM2G002642_T02 methyltransferase domain coordinates 271-489
VVLDVGCGVASFGGYLFDRDVITMSFAPKDEHEAQVQFALERGIPAISAVMGTKRLPFPSRVFDVVHCARCRVPWHIEGGKLLLELDRLLRPGGYFVWSATPVYQKLPEDVEIWQAMSALTSSMCWKMVNKVKDRVNRVGIAIYRKPTDNSCYEARSETNPPLCGEYDDPDAAWNISLGACMHKLPVDPTVRGSQWPELWPLRLEKPPYWLRGSEAGVY

SEQ ID NO: 782 - protein, 219 aa, Setaria italica
  Si021320m methyltransferase domain coordinates 337-555
VVLDVGCGVASFGGYLFDRDVITMSFAPKDEHEAQVQFALERGIPAISAVMGTKRLPFPSRVFDVVHCARCRVPWHIEGGKLLLELDRLLRPGGYFVWSATPVYQKLPEDVEIWEAMSALTRSMCWKMVNKVKDRVNRVGIAIFRKPTDNSCYEERSEANSPICGEYDDPDAAWNVSLRTCMHKLPVDLTIRGSKWPELWPLRLEKPPYWLKSSEAGVY

SEQ ID NO: 783 - protein, 220 aa, Brachypodium distachyon
  Bradi4g23610.1 methyltransferase domain coordinates 469-688
VVLDVGCGVASFGGFLFDRGALTMSFAPKDEHEAQVQFALERGIPALSAVMGTKRLPFPAGVFDVVHCARCRVPWHIDGGMLLLELNRLLRPGGFFVWSATPVYQKLPEDVEIWDDMVKLTKAMCWEMVKKTEDTLDQVGLVIFRKPKSNRCYETRRQKEPPLCDGSDDPNAAWNIKLRACMHRAPADYPSVRGSRWPAPWPERAEAVPYWLNNSQVGVY

SEQ ID NO: 784 - protein, 219 aa, Oryza sativa
  LOC_Os11g08314.1 methyltransferase domain coordinates 468-686
VALDVGCGVASFGGYLFDHDVLTMSLAPKDEHEAQVQFALERGIPAISAVMGTRRLPFPSNVFDAVHCARCRVPWHIEGGMLLLELNRLLRPGGFFVWSATPVYQELPEDVEIWGEMVKLTKAMCWEMVSKTSDTVDQVGLVTFRKPADNACYMKRRQKEPPLCEPSDDPNAAWNITLRACMHWVPTDPSVRGSWWPERWPERMEKTPYWLNSSQVGVY

SEQ ID NO: 785 - protein, 221 aa, Setaria italica
  Si028042m methyltransferase domain coordinates 434-654
VVLDVGCGVASFGGYLFDRDVLTMSLAPKDEHEAQVQFALERGIPAISAVMGTRRLPFPGGVFDVVHCARCRVPWHIDGGMLLLELNRLLRPGGVFVWSATPVYQKLPDDVEIWDEMAKLTKAMCWEMVAKTKHTVVDDQVGVAIFRKPERNGCYEKRPEKAPPLCEPSDDPNAAWNIKLRACMHRVPEDPSERGARWPEPWPERLGKAPYWLDGSQTGVY

SEQ ID NO: 786 - protein, 218 aa, Arabidopsis thaliana
  AT1G29470.1 methyltransferase domain coordinates 367-584
VILDVGCGVASFGGYLFDRDVLALSFAPKDEHEAQVQFALERGIPAMSNVMGTKRLPFPGSVFDLIHCARCRVPWHIEGGKLLLELNRALRPGGFFVWSATPVYRKTEEDVGIWKAMSKLTKAMCWELMTIKKDELNEVGAAIYQKPMSNKCYNERSQNEPPLCKDSDDQNAAWNVPLEACIHKVTEDSSKRGAVWPESWPERVETVPQWLDSQEGVY

SEQ ID NO: 787 - protein, 218 aa, Arabidopsis thaliana
  AT2G34300.1 methyltransferase domain coordinates 367-584
VILDVGCGVASFGGYLFERDVLALSFAPKDEHEAQVQFALERGIPAMLNVMGTKRLPFPGSVFDLIHCARCRVPWHIEGGKLLLELNRALRPGGFFVWSATPVYRKNEEDSGIWKAMSELTKAMCWKLVTIKKDKLNEVGAAIYQKPTSNKCYNKRPQNEPPLCKDSDDQNAAWNVPLEACMHKVTEDSSKRGAVWPNMWPERVETAPEWLDSQEGVY

SEQ ID NO: 788 - protein, 218 aa, Populus trichocarpa
  POPTR_0002s07640.1 methyltransferase domain coordinates 412-629
VILDVGCGVASFGGYLLEKDVLAMSFAPKDEHEAQVQFALERGIPAMLAVMGTKRLPFPNSVFDLVHCARCRVPWHIEGGKLLLELNRVLRPGGYFVWSATPVYRKRPEDVGIWKAMSKLTKSMCWDLVVIKTDTLNGVGAAIYRKPTSNDCYNNRPQNEPPLCKESDDPNAAWNVLLEACMHKVPVDASVRGSHWPEQWPKRLEKPPYWLNSQVGVY

SEQ ID NO: 789 - protein, 218 aa, Populus trichocarpa
  POPTR_0005s20670.1 methyltransferase domain coordinates 423-640
VILDVGCGVASFGGYLFERDVLAMSFAPKDEHEAQVQFALERGIPAMLAVMGTKRLPFPSSVFDVVHCARCRVPWHVEGGKLLLELNRVLRPGGYFVWSATPVYQKLPEDVGIWKAMSKLTKSMCWDLVVIKKDKLNGVGAAIFRKPTSNDCYNNRPQNEPPLCKESDDPNAAWNVPLEACMHKVPEDASVRGSRWPEQWPQRLEKPPYWLNSQVGVY

SEQ ID NO: 790 - protein, 217 aa, Eucalyptus grandis
  Eucgr.F04285.1 methyltransferase domain coordinates 423-639
VILDVGCGVASFGGYLFERDVLTMSFAPKDVHEAQVQFALERGIPAILGVMGTKRLPFPGGVFDVIHCARCRVPWHIEGGKLLLELNRVLRPGGYFLWSATPIYRRDQEDIGIWKEMSKLTMAMCWDLVMIKKDKLNKVAIAMYRKPTSNECYEKRPQNEPPLCDNFDDPNSAWNVTLQACMHKVPVDMSKRGSNWPEKWPVRLEKPPYWLNELGVY

SEQ ID NO: 791 - protein, 218 aa, Eucalyptus grandis
  Eucgr.F04286.1 methyltransferase domain coordinates 407-624
VILDVGCGVGSFGGYLFERDVLTMSFAPKDEHEAQVQFALERGIPAMLAVMGTKRLPFPSGVFDAIHCARCRVPWHIEGGKLLLELNRLLRPGGYFVWSATPIYRKGPEDLGIWKEMSKLTTAMCWNFTLIKRKDKMNKVSIALYRKPTSNECIESRTKNEPPLCNGLDDANSTWNVTLQACMHKVPTDMSERGSQWPENWLHRLGKPPYWLNKVAVN

SEQ ID NO: 792 - protein, 218 aa, Glycine max
  Glyma04g42270.1 methyltransferase domain coordinates 429-646
VILDVGCGVASFGGYLFEKDVLTMSFAPKDVHEAQVQFALERGIPATLGVMGTVRLPYPGSVFDLVHCARCRVPWHIEGGKLLLELNRVLRPGGHFVWSATPVYQKDPEDVEIWKAMGEITKSMCWDLVVIAKDKLNGVAAAIYRKPTDNECYNNRIKHEPPMCSESDDPNTAWNVSLQACMHKVPVDASERGSIWPEQWPLRLEKPPYWIDSQAGVY

SEQ ID NO: 793 - protein, 218 aa, Glycine max
  Glyma06g12540.1 methyltransferase domain coordinates 406-623
VILDVGCGVASFGGYLFEKDVLTMSFAPKDVHEAQVQFALERGIPATLGVMGTVRLPYPGSVFDLLHCARCRVPWHVEGGKLLLELNRVLRPGGYFVWSATPVYQKDPEDVEIWKAMGEITKSMCWDLVVIAKDKLNGVAAAIYRKPTDNECYNNRIKNEPSMCSESDDPNTAWNVSLQACMHKVPVDASERGSIWPEQWPLRLEKPPYWIDSQAGVY

SEQ ID NO: 794 - protein, 219 aa, Vitis vinifera
  GSVIVT01008776001 methyltransferase domain coordinates 150-368
VILDVGCGVASFGGYIFERDVLAMSFAPKDEHEAQVQFALERGIPAISAVMGTTRLPFPSRVFDVVHCARCRVPWHIEGGKLLLELNRVLRPGGYFVWSATPVYRKVPEDVGIWNAMSEITKKICWDLVAMSKDSLNGIGAAIYRKPTSNECYEKRPRNEPPLCEESDNADAAWNIPLQACMHKVPVLTSERGSQWPEQWPLRVEKAPNWLKSSQVGVY

SEQ ID NO: 795 - protein, 219 aa, Solanum lycopersicum
  Solyc04g063230.2.1 methyltransferase domain coordinates 364-582
VILDVGCGVASFGGYLFERDVLAMSLAPKDEHEAQVQFALERGIPAISAVMGTKRLPFPGKVFDAVHCARCRVPWHIEGGKLLLELNRVLRPGGHFIWSATPVYRKDEENVGIWEAMSELTKSMCWELLEINEDKLNEVGVAIFRKPTTNDCYQSRTQNDPPMCEEADDPDAAWNITLQACLHKAPADASARGAKWPAKWPLRSEKLPYWLKSSQVGVY

SEQ ID NO: 796 - protein, 219 aa, Arabidopsis thaliana
  AT5G64030.1 methyltransferase domain coordinates 425-643
VVLDVGCGVASFGGFLFDRDVITMSLAPKDEHEAQVQFALERGIPAISAVMGTTRLPFPGRVFDIVHCARCRVPWHIEGGKLLLELNRVLRPGGFFVWSATPVYQKKTEDVEIWKAMSELIKKMCWELVSINKDTINGVGVATYRKPTSNECYKNRSEPVPPICADSDDPNASWKVPLQACMHTAPEDKTQRGSQWPEQWPARLEKAPFWLSSSQTGVY

SEQ ID NO: 797 - protein, 219 aa, Eucalyptus grandis
  Eucgr.I00186.1 methyltransferase domain coordinates 410-628
VILDVGCGVASFGGYLFDRDVLAMSLAPKDEHEAQVQFALERGIPAISAVMGTTRLPFPSRVFDIVHCARCRVPWHIEGGKLLLELNRLLRPGGFFVWSATPVYQKIPDDVAIWKAMSALLKSMCWELISINKDTLNGVGVATYRKPMSNECYEKRSQNDPPMCADSDDSNAAWYVPLQTCMHKIPIDSAERGSQWPEEWPARLVKTPYWLLSSQVGVY

SEQ ID NO: 798 - protein, 219 aa, Glycine max
  Glyma04g38870.1 methyltransferase domain coordinates 390-608
VILDVGCGVASFGGFLFDRDVLAMSLAPKDEHEAQVQFALERGIPAISAVMGTKRLPFPGKVFDVVHCARCRVPWHIEGGKLLLELNRVLRPGGFFVWSATPIYQKLPEDVEIWKAMKTLTKAMCWEVVSISKDQVNGVGVAVYKKPTSNECYEQRSKNEPPLCPDSDDPNAAWNIKLQACMHKVPASSKERGSKLPELWPARLTKVPYWLLSSQVGVY

SEQ ID NO: 799 - protein, 219 aa, Glycine max
  Glyma06g16050.1 methyltransferase domain coordinates 402-620
VILDVGCGVASFGGFLFDRDVLAMSLAPKDEHEAQVQFALERGIPAISAVMGTKRLPFPGKVFDVVHCARCRVPWHIEGGKLLLELNRVLRPGGFFVWSATPIYQKLPEDVEIWKAMKALTKAMCWEVVSISKDPVNGVGVAVYRKPTSNECYEQRSKNEPPLCPDSDDPNAAWNIQLQACLHKAPVSSKERGSKLPELWPARLIKVPYWLSSSQVGVY

SEQ ID NO: 800 - protein, 219 aa, Glycine max
  Glyma05g32670.1 methyltransferase domain coordinates 427-645
VILDVGCGVASFGGFLFERDVLTMSLAPKDEHEAQVQFALERGIPAISAVMGTKRLPYPGRVFDVVHCARCRVPWHIEGGKLLLELNRVLRPGGFFVWSATPIYQKLPEDVEIWNEMKALTKAMCWEVVSISKDKLNGVGIAVYKKPTSNECYEKRSQNQPPICPDSDDPNAAWNIPLQACMHKVPVSSTERGSQWPEKWPARLTNTPYWLTNSQVGVY

SEQ ID NO: 801 - protein, 219 aa, Glycine max
  Glyma08g00320.1 methyltransferase domain coordinates 438-656
VILDVGCGVASFGGFLFERDVLTMSLAPKDEHEAQVQFALERGIPAISAVMGTKRLPYPGRVFDVVHCARCRVPWHIEGGKLLLELNRVLRPGGFFVWSATPIYQKLPEDVEIWNEMKALTKAMCWEVVSISKDKLNGVGIAVYKKPTSNECYEKRSQNQPPICPDSDDPNAAWNVPLQACMHKVPVSSTERGSQWPEKWPARLTNIPYWLTNSQVGVY

SEQ ID NO: 802 - protein, 219 aa, Solanum lycopersicum
  Solyc05g056580.2.1 methyltransferase domain coordinates 409-627
VILDVGCGVASFGGYLFERDVLAMSLAPKDEHEAQVQFALERGIPAISAVMGTKRLPFPSRVFDVVHCARCRVPWHIEGGKLLLELNRVLRPGGLFVWSATPVYQKLPEDVEIWEAMQKLTKAMCWDLVSKTKDRVNGVGVAVYRKPTSNECYEQRSKDAPPICQGSDDPNAAWNVPLQACMHKAPVATSERGSQWPEPWPARLSKSPYWLLSSQVGVY

SEQ ID NO: 803 - protein, 219 aa, Populus trichocarpa
  POPTR_0005s06640.1 methyltransferase domain coordinates 392-610
VILDVGCGVASFGGYLFDRDVLAMSFAPKDEHEAQIQFALERGIPAISAVMGTKRLPYPGRVFDAVHCARCRVPWHIEGGKLLLELNRVLRPGGFFVWSATPVYQKLAEDVEIWQAMTELTKAMCWELVSINKDTLNGVGVATYRKPTSNDCYEKRSKQEPPLCEASDDPNAAWNVPLQACMHKVPVGSLERGSQWPEQWPARLDKTPYWMLSSQVGVY

SEQ ID NO: 804 - protein, 219 aa, Populus trichocarpa
  POPTR_0007s04340.1 methyltransferase domain coordinates 420-638
VILDVGCGVASFGGYLFDRDVLTMSFAPKDEHEAQVQFALERGIPAISAVMGTKRLPYPGRVFDAVHCARCRVPWHIEGGKLLLELNRVLRPGGLFVWSATPVYQKLAEDVEIWQAMTELTKAMCWELVSINKDTINGVGVATYRKPTSNDCYEKRSKQEPPLCEASDDPNAAWNVPLQACMHKVPVDSLERGSQWPEQWPARLGKTPYWMLSSQVGVY

SEQ ID NO: 805 - protein, 219 aa, Vitis vinifera
  GSVIVT01026451001 methyltransferase domain coordinates 357-575
VVLDVGCGVASFGGYLFDKDVLTMSFAPKDEHEAQVQFALERGIPGISAVMGTKRLPFPAMVFDVVHCARCRVPWHIEGGKLLLELNRVLRPGGFFVWSATPVYQKLADDVAIWNAMTELMKSMCWELVVIKRDVVNRVAAAIYKKPTSNDCYEKRSQNEPPICADSEDANAAWNVPLQACMHKVPVDASKRGSQWPELWPARLDKSPYWLTSSQVGVY

SEQ ID NO: 806 - protein, 55 aa, Brachypodium distachyon
  Bradi3g11520.1 bHLH domain 40-94
RKVQKADRERMRRDKLNEQFQELGTTLDPDRPRNDKATILGDTIQMLKDLSSQVN

SEQ ID NO: 807 - protein, 55 aa, Oryza sativa
  LOC_Os02g23823.1 bHLH domain 40-94
RKVQKADREKMRRDRLNEQFQELGSTLDPDRPRNDKATILSDAIQMLKDLTSQVN

SEQ ID NO: 808 - protein, 55 aa, Setaria italica
  Si017804m bHLH domain 36-90
RKVQKADREKMRRDKLNEQFQELGNTLDPDRPRNDKATILGDTIQMLKDLTSHVN

SEQ ID NO: 809 - protein, 59 aa, Arabidopsis thaliana
  AT4G36060.1 bHLH domain 41-99
KKEAVCSQKAEREKLRRDKLKEQFLELGNALDPNRPKSDKASVLTDTIQMLKDVMNQVD

SEQ ID NO: 810 - protein, 55 aa, Glycine max
  Glyma07g26910.1 bHLH domain 56-110
RKVLKADREKLRRDRLNEHFQELGNALDPDRPKNDKATILTETVQMLKDLTAEVN

SEQ ID NO: 811 - protein, 55 aa, Populus trichocarpa
  POPTR_0005s11550.1 bHLH domain 61-115
KKVQKADREKLRRDNLNEQFLELGTTLDPDRPKNDKATILTDTIQVLKDLTAEVN

SEQ ID NO: 812 - protein, 41 aa, Vitis vinifera
  GSVIVT01018777001 bHLH domain 50-104
RLNEHFLELGNTLDPDRPKNDKATILADTIQMLKDLTAEVN

SEQ ID NO: 813 - protein, 55 aa, Arabidopsis thaliana
  AT3G19860.1 bHLH domain 6-60
RKSQKAGREKLRREKLNEHFVELGNVLDPERPKNDKATILTDTVQLLKELTSEVN

SEQ ID NO: 814 - protein, 55 aa, Citrus clementina
  clementine0.9_014901m bHLH domain 59-114
RKMQKADREKLRRDRLNEHFTELGNALDPDRPKNDKATILADTVQLLKDLTSQVE

SEQ ID NO: 815 - protein, 55 aa, Citrus clementina; identical to SEQ ID NO: 814
  clementine0.9_014926m bHLH domain 60-114

SEQ ID NO: 816 - protein, 55 aa, Glycine max
  Glyma08g15740.1 bHLH domain 7-61
RKTQKADREKLRRDRLNEQFVELGNILDPDRPKNDKATIIGDTIQLLKDLTSQVS

SEQ ID NO: 817 - protein, 55 aa, Glycine max
  Glyma15g29630.1 bHLH domain 21-75
RKTQKADREKLRRDRINEQFVELGNILDPDRPKNDKATILCDTIQLLKDLISQVS

SEQ ID NO: 818 - protein, 55 aa, Glycine max
  Glyma12g02740.1 bHLH domain 7-61
RKTQKADREKLRRDRFNVQFVELGNILDPDRPKNDKATILGDTIQLLKDLTSEVS

SEQ ID NO: 819 - protein, 55 aa, Populus trichocarpa
  POPTR_0004s17540.1 bHLH domain 42-96
RKIQKADREKLRRDRLNEHFVELGNTLDPDRPKNDKATILADTIQLLKDLTSQVD

SEQ ID NO: 820 - protein, 55 aa, Populus trichocarpa
  POPTR_0009s13220.1 bHLH domain 38-92
RKIQKADREKLRRDRLNEHFVELGNTLDPDRPKNDKATILADTVQLLKDLNSKVD

SEQ ID NO: 821 - protein, 55 aa, Vitis vinifera
  GSVIVT01024084001 bHLH domain 46-100
RKVQKADREKLRRDRLNEQFIELGNALDPDRPKNDKATILSDTIQLLKDLTAQVE

SEQ ID NO: 822 - protein, 55 aa, Solanum lycopersicum
  Solyc01g111130.2.1 bHLH domain 57-111
RKVQKADREKLRRDRLNEQFMELGKTLDPDRPKNDKASILSDTVQILKDLTAQVS

SEQ ID NO: 823 - protein, 55 aa, Zea mays
  GRMZM2G114444_T02 bHLH domain 30-84
RKVQKADREKMRRDKLNEQFQDLGNALDPDRPRNDKATILGDTIQMLKDLTTQVN

SEQ ID NO: 824 - protein, 37 aa, Brachypodium distachyon
  Bradi3g11520.1 bHLH domain 95-131
KLKAEYSSLSEEERELTQEKNELRDEKASLKSDIDNL

SEQ ID NO: 825 - protein, 37 aa, Oryza sativa
  LOC_Os02g23823.1 bHLH domain 95-131
KLKAEYTSLSEEARELTQEKNELRDEKVSLKFEVDNL

SEQ ID NO: 826 - protein, 37 aa, Setaria italica
  Si017804m bHLH domain 91-127
KLKAEYTSLSEEARELTQEKNELRDEKASLKSEVDNL

SEQ ID NO: 827 - protein, 37 aa, Arabidopsis thaliana
  AT4G36060.1 bHLH domain 100-136
RLKAEYETLSQESRELIQEKSELREEKATLKSDIEIL

SEQ ID NO: 828 - protein, 37 aa, Glycine max
  Glyma07g26910.1 bHLH domain 111-147
RLKTEHKTLSEESRELMQEKNELREEKTSLKSDIENL

SEQ ID NO: 829 - protein, 37 aa, Populus trichocarpa
  POPTR_0005s11550.1 bHLH domain 116-152
RLKAECATLSEETHELMQEKNELREEKASLKADTENL

SEQ ID NO: 830 - protein, 37 aa, Vitis vinifera
  GSVIVT01018777001 bHLH domain 105-141
RLKVECAALSEESRELVQEKNELREEKVALKSDIDNL

SEQ ID NO: 831 - protein, 37 aa, Arabidopsis thaliana
  AT3G19860.1 bHLH domain 61-97
KLKSEYTALTDESRELTQEKNDLREEKTSLKSDIENL

SEQ ID NO: 832 - protein, 37 aa, Citrus clementina
  clementine0.9_014901m bHLH domain 115-151
KLKTEHAALTEESRELTQEKNDLREEKLSLRSEIENL

SEQ ID NO: 833 - protein, 37 aa, Citrus clementina; identical to SEQ ID NO: 832
  clementine0.9_014926m bHLH domain 115-151

SEQ ID NO: 834 - protein, 37 aa, Glycine max
  Glyma08g15740.1 bHLH domain 62-98
KLKDEYATLNEESRELTQEKNDLREEKASLKSDIGNL

SEQ ID NO: 835 - protein, 37 aa, Glycine max
  Glyma15g29630.1 bHLH domain 76-112
KLKDEYAMLNEESRELTLEKTDLREEKASLKSDIDNL

SEQ ID NO: 836 - protein, 37 aa, Glycine max
  Glyma12g02740.1 bHLH domain 62-98
KLKDEYATLNEESCELAQEKNELREEKASLKSDILKL

SEQ ID NO: 837 - protein, 37 aa, Populus trichocarpa
  POPTR_0004s17540.1 bHLH domain 97-133
KLKAEYATLSEESLELTQEKNDLREEKASLKSDIENL

SEQ ID NO: 838 - protein, 37 aa, Populus trichocarpa
  POPTR_0009s13220.1 bHLH domain 93-129
KLKAEHAALSEESRELTLEKNDLREEKASLKSDVENL

SEQ ID NO: 839 - protein, 37 aa, Vitis vinifera
  GSVIVT01024084001 bHLH domain 101-137
KLKAENASLNEESRELTQEKNDLREEKASLKSATENL

SEQ ID NO: 840 - protein, 37 aa, Solanum lycopersicum
  Solyc01g111130.2.1 bHLH domain 112-148
RLKSEYAALTDESRELTQEKNDLREEKASLKSDIESL

SEQ ID NO: 841 - protein, 37 aa, Zea mays
  GRMZM2G114444_T02 bHLH domain 85-121
KLKAEYTSLSEEACELTQEKNELRDEKASLKSEVDNL

SEQ ID NO: 842 - protein, 48 aa, Arabidopsis thaliana
  misc_feature (1)..(1): Xaa is Lys or Arg
  misc_feature (3)..(3): Xaa can be any naturally occurring amino acid
  misc_feature (5)..(5): Xaa can be any naturally occurring amino acid
  misc_feature (6)..(7): Xaa is Gln or Glu
  misc_feature (11)..(11): Xaa can be any naturally occurring amino acid
  misc_feature (13)..(13): Xaa is Thr or Val
  misc_feature (14)..(16): Xaa can be any naturally occurring amino acid
  misc_feature (17)..(17): Xaa is Ser, Ala, Thr or Gly
  misc_feature (18)..(18): Xaa can be any naturally occurring amino acid
  misc_feature (19)..(19): Xaa is Phe, Ile, Leu, Val or Met
  misc_feature (23)..(23): Xaa is Arg or Lys
  misc_feature (26)..(26): Xaa can be any naturally occurring amino acid
  misc_feature (27)..(27): Xaa is Ile, Leu, Val or Met
  misc_feature (29)..(30): Xaa can be any naturally occurring amino acid
  misc_feature (31)..(31): Xaa is Ser or Ala
  misc_feature (34)..(34): Xaa can be any naturally occurring amino acid
  misc_feature (42)..(42): Xaa is Ile, Leu, Val or Met
  misc_feature (45)..(45): Xaa can be any naturally occurring amino acid
  AT3G53200 (G1311) clade Myb1 consensus sequence
XGXWXXXEDEXLXXXXXXXGERXWDXXAXXXGLXRSGKSCRXRWXNYL

SEQ ID NO: 843 - protein, 49 aa, Arabidopsis thaliana
  misc_feature (1)..(3): Xaa can be any naturally occurring amino acid
  misc_feature (4)..(4): Xaa is Phe, Ile, Leu, Val or Met
  misc_feature (6)..(6): Xaa can be any naturally occurring amino acid
  misc_feature (10)..(10): Xaa can be any naturally occurring amino acid
  misc_feature (11)..(11): Xaa is Ile, Leu, Val or Met
  misc_feature (13)..(13): Xaa is Phe, Ile, Leu, Val or Met
  misc_feature (14)..(14): Xaa is Gln or Lys
  misc_feature (15)..(15): Xaa is Phe, Ile, Leu, Val or Met
  misc_feature (16)..(16): Xaa is His or Gln
  misc_feature (17)..(22): Xaa can be any naturally occurring amino acid
  misc_feature (23)..(23): Xaa is Leu or absent
  misc_feature (24)..(24): Xaa is His or absent
  misc_feature (25)..(25): Xaa is Gly or absent
  misc_feature (27)..(27): Xaa is Ser or Ala
  misc_feature (28)..(28): Xaa can be any naturally occurring amino acid
  misc_feature (31)..(32): Xaa can be any naturally occurring amino acid
  misc_feature (44)..(44): Xaa can be any naturally occurring amino acid
  misc_feature (46)..(46): Xaa is Lys or Arg
  misc_feature (48)..(49): Xaa can be any naturally occurring amino acid
  AT3G53200 (G1311) clade Myb2 consensus sequence
XXXXSXEEEXXIXXXXXXXXXXXXXWXXIAXXLPGRTDNEIKNXWXTXX

SEQ ID NO: 844 - protein, 85 aa, Arabidopsis thaliana
  misc_feature (1)..(1): Xaa is Ser or Thr
  misc_feature (9)..(9): Xaa can be any naturally occurring amino acid
  misc_feature (10)..(10): Xaa is His or Trp
  misc_feature (12)..(13): Xaa is Asp or Glu
  misc_feature (14)..(14): Xaa can be any naturally occurring amino acid
  misc_feature (15)..(15): Xaa is Phe or Tyr
  misc_feature (16)..(16): Xaa is Ile, Leu, Val or Met
  misc_feature (17)..(17): Xaa is His or absent
  misc_feature (18)..(20): Xaa can be any naturally occurring amino acid
  misc_feature (21)..(21): Xaa is Phe, Ile, Leu, Val or Met
  misc_feature (22)..(24): Xaa can be any naturally occurring amino acid
  misc_feature (25)..(25): Xaa is Ala or Gly
  misc_feature (26)..(26): Xaa is Pro or absent
  misc_feature (27)..(27): Xaa is Gln or absent
  misc_feature (28)..(28): Xaa is Glu or Gln
  misc_feature (29)..(32): Xaa can be any naturally occurring amino acid
  misc_feature (34)..(34): Xaa is Ile, Leu, Val or Met
  misc_feature (37)..(37): Xaa is Asn or Asp
  misc_feature (39)..(43): Xaa can be any naturally occurring amino acid
  misc_feature (44)..(44): Xaa is Glu or Gln
  misc_feature (49)..(49): Xaa is Ile, Leu, Val or Met
  misc_feature (51)..(51): Xaa is Phe, Ile, Leu, Val or Met
  misc_feature (52)..(53): Xaa can be any naturally occurring amino acid
  misc_feature (54)..(54): Xaa is His, Gln or Arg
  misc_feature (55)..(55): Xaa is Ala, Ser or Gly
  misc_feature (56)..(56): Xaa can be any naturally occurring amino acid
  misc_feature (59)..(60): Xaa can be any naturally occurring amino acid
  misc_feature (62)..(63): Xaa can be any naturally occurring amino acid
  misc_feature (64)..(64): Xaa is Phe or Tyr
  misc_feature (66)..(68): Xaa can be any naturally occurring amino acid
  misc_feature (69)..(69): Xaa is Ile, Leu, Val or Met
  misc_feature (70)..(72): Xaa can be any naturally occurring amino acid
  misc_feature (73)..(73): Xaa is Pro or absent
  misc_feature (74)..(76): Xaa can be any naturally occurring amino acid
  misc_feature (77)..(77): Xaa is Phe or Tyr
  misc_feature (78)..(78): Xaa is Lys or Arg
  misc_feature (79)..(79): Xaa is Ile, Leu, Val or Met
  misc_feature (83)..(84): Xaa can be any naturally occurring amino acid or absent
  misc_feature (85)..(85): Xaa is Ser or Gly
  AT5G54900 (G1940) clade RRM1 consensus sequence
XLWIGDLQXXMXXXXXXXXXXXXXXXXXXXXXKXIRXKXXXXXXGYGFXEXXXXXXAEXXLXXXNXXXXXXXXXXXXXXNWAXXX

SEQ ID NO: 845 - protein, 80 aa, Arabidopsis thaliana
  misc_feature (1)..(1): Xaa is Glu or Asp
  misc_feature (2)..(2): Xaa can be any naturally occurring amino acid
  misc_feature (3)..(3): Xaa is Ala or Thr
  misc_feature (4)..(4): Xaa is Ile, Leu, Val or Met
  misc_feature (6)..(6): Xaa is Ile, Leu, Val or Met
  misc_feature (11)..(11): Xaa can be any naturally occurring amino acid
  misc_feature (12)..(12): Xaa is Glu or Asp
  misc_feature (14)..(14): Xaa can be any naturally occurring amino acid
  misc_feature (16)..(16): Xaa can be any naturally occurring amino acid
  misc_feature (17)..(17): Xaa is Ile, Leu, Val or Met
  misc_feature (19)..(19): Xaa can be any naturally occurring amino acid
  misc_feature (20)..(20): Xaa is Glu or Asp
  misc_feature (21)..(21): Xaa can be any naturally occurring amino acid
  misc_feature (23)..(23): Xaa is Lys or Arg
  misc_feature (24)..(25): Xaa can be any naturally occurring amino acid
  misc_feature (26)..(26): Xaa is Phe or Tyr
  misc_feature (27)..(27): Xaa can be any naturally occurring amino acid
  misc_feature (29)..(29): Xaa can be any naturally occurring amino acid
  misc_feature (30)..(30): Xaa is Lys or Arg
  misc_feature (31)..(31): Xaa is Ser or Gly
  misc_feature (33)..(33): Xaa is Asn or Lys
  misc_feature (34)..(34): Xaa is Ile, Leu, Val or Met
  misc_feature (36)..(36): Xaa can be any naturally occurring amino acid
  misc_feature (38)..(38): Xaa is Lys or Arg
  misc_feature (39)..(39): Xaa can be any naturally occurring amino acid
  misc_feature (41)..(43): Xaa can be any naturally occurring amino acid
  misc_feature (46)..(46): Xaa is Phe or Tyr
  misc_feature (49)..(49): Xaa is Ile, Leu, Val or Met
  misc_feature (50)..(50): Xaa can be any naturally occurring amino acid
  misc_feature (52)..(52): Xaa is Ala, Ser or Gly
  misc_feature (53)..(53): Xaa is Glu or Asp
  misc_feature (54)..(55): Xaa can be any naturally occurring amino acid
  misc_feature (58)..(59): Xaa can be any naturally occurring amino acid
  misc_feature (62)..(62): Xaa can be any naturally occurring amino acid
  misc_feature (65)..(65): Xaa is Asn or Gln
  misc_feature (67)..(69): Xaa can be any naturally occurring amino acid
  misc_feature (71)..(71): Xaa is Ser or Thr
  misc_feature (73)..(73): Xaa can be any naturally occurring amino acid
  misc_feature (74)..(74): Xaa is Ile, Leu, Val or Met
  misc_feature (76)..(76): Xaa can be any naturally occurring amino acid
  misc_feature (78)..(78): Xaa can be any naturally occurring amino acid
  misc_feature (80)..(80): Xaa is Ala, Ser or Thr
  AT5G54900 (G1940) clade RRM2 consensus sequence
XXXXFXGDLAXXVXDXXLXXXFXXXXXSXXXAXXVXDXXTXXXKGXGFXXFXXXXEQXXAMXEMXGXXXSXRXXRXGXAX

SEQ ID NO: 846 - protein, 73 aa, Arabidopsis thaliana
  misc_feature (1)..(1): Xaa can be any naturally occurring amino acid
  misc_feature (3)..(3): Xaa is Ile, Leu, Val or Met
  misc_feature (7)..(7): Xaa can be any naturally occurring amino acid
  misc_feature (8)..(8): Xaa is Ile, Leu, Val or Met
  misc_feature (10)..(11): Xaa can be any naturally occurring amino acid
  misc_feature (12)..(12): Xaa is Ile, Leu, Val or Met
  misc_feature (13)..(13): Xaa can be any naturally occurring amino acid
  misc_feature (14)..(14): Xaa is Glu or Asp
  misc_feature (15)..(15): Xaa is Asn, Glu or Asp
  misc_feature (16)..(16): Xaa can be any naturally occurring amino acid
  misc_feature (18)..(18): Xaa is Lys or Arg
  misc_feature (19)..(20): Xaa can be any naturally occurring amino acid
  misc_feature (22)..(23): Xaa can be any naturally occurring amino acid
  misc_feature (24)..(24): Xaa is Phe or Tyr
  misc_feature (26)..(26): Xaa is Glu, Gln or Asp
  misc_feature (27)..(27): Xaa is Ile, Leu, Val or Met
  misc_feature (28)..(29): Xaa can be any naturally occurring amino acid
  misc_feature (33)..(34): Xaa can be any naturally occurring amino acid
  misc_feature (37)..(37): Xaa can be any naturally occurring amino acid
  misc_feature (41)..(41): Xaa is Ile, Leu, Val or Met
  misc_feature (43)..(43): Xaa is Phe or Tyr
  misc_feature (44)..(45): Xaa can be any naturally occurring amino acid
  misc_feature (46)..(46): Xaa is Lys or Arg
  misc_feature (47)..(47): Xaa can be any naturally occurring amino acid
  misc_feature (48)..(48): Xaa is Ser or Cys
  misc_feature (49)..(49): Xaa is Ala or Ser
  misc_feature (50)..(50): Xaa is Glu or Asp
  misc_feature (51)..(51): Xaa can be any naturally occurring amino acid
  misc_feature (53)..(53): Xaa is Ile, Leu, Val or Met
  misc_feature (54)..(55): Xaa can be any naturally occurring amino acid
  misc_feature (57)..(57): Xaa can be any naturally occurring amino acid
  misc_feature (59)..(60): Xaa can be any naturally occurring amino acid
  misc_feature (61)..(61): Xaa is Ile, Leu, Val or Met
  misc_feature (62)..(62): Xaa is Ser, Ala or Gly
  misc_feature (63)..(63): Xaa is Ala or Gly
  misc_feature (64)..(66): Xaa can be any naturally occurring amino acid
  misc_feature (73)..(73): Xaa can be any naturally occurring amino acid
  AT5G54900 (G1940) clade RRM3 consensus sequence
XTXFVGXXDXXXXXXXLXXXFXXXGXXXXVKIXXGKXCGFXQXXXXXXXXXAXXXLXGXXXXXXXXRLSWGRX

SEQ ID NO: 847 - protein, 62 aa, Arabidopsis thaliana
  misc_feature (2)..(2): Xaa is Lys or Arg
  misc_feature (3)..(3): Xaa can be any naturally occurring amino acid
  misc_feature (4)..(4): Xaa is Ser or Pro
  misc_feature (10)..(10): Xaa can be any naturally occurring amino acid
  misc_feature (13)..(13): Xaa is Asp or Glu
  misc_feature (19)..(19): Xaa is Ile, Leu, Val or Met
  misc_feature (21)..(21): Xaa is Ile, Leu, Val or Met
  misc_feature (23)..(23): Xaa is Ala or Pro
  misc_feature (30)..(30): Xaa is Phe or Tyr
  misc_feature (34)..(34): Xaa is Lys or Arg
  misc_feature (37)..(37): Xaa can be any naturally occurring amino acid
  misc_feature (38)..(38): Xaa is His or Asn
  misc_feature (40)..(40): Xaa is Ser or Thr
  misc_feature (45)..(45): Xaa is Ile, Leu, Val or Met
  misc_feature (46)..(46): Xaa is Gln or Glu
  misc_feature (51)..(51): Xaa is His, Gln or Lys
  misc_feature (55)..(55): Xaa is Ser or Ala
  misc_feature (57)..(57): Xaa is Ile, Leu, Val or Met
  misc_feature (58)..(58): Xaa is Ser or Ala
  misc_feature (61)..(62): Xaa can be any naturally occurring amino acid
  AT5G41030 (G1936) clade TCP consensus sequence
KXXXNKDRHXKVXGRGRRXRXPXLCAARIXQLTXELXXKXDGETXXWLLQXAEPXIXXATXX

SEQ ID NO: 848 - protein, 57 aa, Arabidopsis thaliana
  misc_feature (1)..(1): Xaa is Arg or Lys
  misc_feature (2)..(2): Xaa can be any naturally occurring amino acid
  misc_feature (4)..(5): Xaa can be any naturally occurring amino acid
  misc_feature (7)..(7): Xaa can be any naturally occurring amino acid
  misc_feature (8)..(8): Xaa is His or Tyr
  misc_feature (9)..(9): Xaa is Asn or Lys
  misc_feature (10)..(11): Xaa can be any naturally occurring amino acid
  misc_feature (14)..(14): Xaa is Asn or Lys
  misc_feature (15)..(15): Xaa can be any naturally occurring amino acid
  misc_feature (17)..(17): Xaa is Asp or Asn
  misc_feature (18)..(18): Xaa can be any naturally occurring amino acid
  misc_feature (19)..(19): Xaa is Phe, Ile, Leu, Val or Met
  misc_feature (22)..(22): Xaa is Arg or Lys
  misc_feature (25)..(25): Xaa can be any naturally occurring amino acid
  misc_feature (27)..(27): Xaa is Gln or Lys
  misc_feature (28)..(28): Xaa is Asn, Asp or Glu
  misc_feature (30)..(30): Xaa is Ile, Leu, Val or Met
  misc_feature (33)..(33): Xaa is Ser or Cys
  misc_feature (34)..(34): Xaa can be any naturally occurring amino acid
  misc_feature (36)..(36): Xaa can be any naturally occurring amino acid
  misc_feature (38)..(38): Xaa is Asn or Lys
  misc_feature (39)..(39): Xaa can be any naturally occurring amino acid
  misc_feature (41)..(41): Xaa is Ile Leu, Val or Met
  misc_feature (43)..(43): Xaa can be any naturally occurring amino acid
  misc_feature (44)..(44): Xaa is Asp or Glu
  misc_feature (47)..(47): Xaa can be any naturally occurring amino acid
  misc_feature (49)..(49): Xaa is Ile, Leu, Val or Met
  misc_feature (50)..(51): Xaa can be any naturally occurring amino acid
  misc_feature (53)..(53): Xaa is Gln or Lys
  misc_feature (54)..(54): Xaa is Phe, Ile, Leu, Val or Met
  misc_feature (56)..(56): Xaa is Ile, Leu, Val or Met
  misc_feature (57)..(57): Xaa can be any naturally occurring amino acid
  AT2G46970 (G1649) clade bHLH consensus sequence
XXRXXEXXXXXERXXRXXXNKXMRXLXXLXPNXXKXDXXSXLXXAIXYXXXLXXQXX

SEQ ID NO: 849 - protein, 51 aa, Arabidopsis thaliana
  misc_feature (2)..(2): Xaa is Ile, Leu, Val or Met
  misc_feature (5)..(5): Xaa can be any naturally occurring amino acid
  misc_feature (13)..(13): Xaa is Ile, Leu, Val or Met
  misc_feature (14)..(14): Xaa is Asp or Glu
  misc_feature (17)..(17): Xaa is Ala, Ser or Gly
  misc_feature (21)..(21): Xaa is Ile, Leu, Val or Met
  misc_feature (23)..(23): Xaa can be any naturally occurring amino acid
  misc_feature (31)..(31): Xaa is Gln or Glu
  misc_feature (32)..(32): Xaa can be any naturally occurring amino acid
  AT3G46640 (G2741) clade SANT (AKA, Myb-related, GARP) consensus sequence
RXVWXPQLHKRFXXVVXHLGXKXAVPKTIMXXMNVEGLTRENVASHLQKYR

SEQ ID NO: 850 - protein, 84 aa, Arabidopsis thaliana
  misc_feature (1)..(1): Xaa is Ala or Gly
  misc_feature (2)..(2): Xaa can be any naturally occurring amino acid
  misc_feature (6)..(6): Xaa can be any naturally occurring amino acid
  misc_feature (7)..(7): Xaa is Gln or Glu
  misc_feature (10)..(10): Xaa is Ile, Leu, Val or Met
  misc_feature (11)..(11): Xaa can be any naturally occurring amino acid
  misc_feature (13)..(13): Xaa is Ile, Leu, Val or Met
  misc_feature (14)..(14): Xaa can be any naturally occurring amino acid
  misc_feature (17)..(17): Xaa is Ser or Thr
  misc_feature (18)..(18): Xaa can be any naturally occurring amino acid
  misc_feature (21)..(22): Xaa can be any naturally occurring amino acid
  misc_feature (24)..(24): Xaa is Lys or Arg
  misc_feature (25)..(25): Xaa is Asn, Asp or Glu
  misc_feature (26)..(26): Xaa is Ala or Ser
  misc_feature (27)..(27): Xaa can be any naturally occurring amino acid
  misc_feature (28)..(28): Xaa is Ile, Leu, Val or Met
  misc_feature (30)..(30): Xaa is Ala, Ser or Gly
  misc_feature (34)..(34): Xaa is Asp or Glu
  misc_feature (35)..(35): Xaa can be any naturally occurring amino acid
  misc_feature (36)..(36): Xaa is Ile, Leu, Val or Met
  misc_feature (37)..(37): Xaa is Ala or Ser
  misc_feature (38)..(38): Xaa is Arg or Lys
  misc_feature (40)..(40): Xaa is Ile, Leu, Val or Met
  misc_feature (41)..(43): Xaa can be any naturally occurring amino acid
  misc_feature (45)..(45): Xaa Phe or Tyr
  misc_feature (46)..(46): Xaa is His, Gln, Asn, Arg or Lys
  misc_feature (48)..(48): Xaa can be any naturally occurring amino acid
  misc_feature (49)..(49): Xaa is Ala, Ser or Gly
  misc_feature (53)..(53): Xaa is Lys or Arg
  misc_feature (59)..(59): Xaa is Ile, Leu, Val or Met
  misc_feature (60)..(60): Xaa can be any naturally occurring amino acid
  misc_feature (63)..(63): Xaa can be any naturally occurring amino acid
  misc_feature (64)..(64): Xaa is Lys or Arg
  misc_feature (68)..(69): Xaa can be any naturally occurring amino acid
  misc_feature (70)..(70): Xaa is His, Gln, Lys or Arg
  misc_feature (71)..(71): Xaa can be any naturally occurring amino acid
  misc_feature (72)..(72): Xaa is Ser or Gly
  misc_feature (73)..(73): Xaa is Arg or Lys
  misc_feature (74)..(75): Xaa can be any naturally occurring amino acid
  misc_feature (78)..(78): Xaa can be any naturally occurring amino acid
  misc_feature (80)..(80): Xaa is Arg or Lys
  misc_feature (83)..(83): Xaa can be any naturally occurring amino acid
  misc_feature (84)..(84): Xaa is Gln or Glu
  AT1G33240 (G634) clade Trihelix 1 consensus sequence
XXRWPXXETXXLXXIRXXMDXXFXXXXXKXPLWXXXXXKXXXXGXXRXXKKCXEKFENXXKYXXRTKXXXXXXXXGKXYXFFXX

SEQ ID NO: 851 - protein, 86 aa, Arabidopsis thaliana
  misc_feature (1)..(1): Xaa is Ser or Pro
  misc_feature (7)..(7): Xaa can be any naturally occurring amino acid
  misc_feature (9)..(9): Xaa is Ile, Leu, Val or Met
  misc_feature (10)..(10): Xaa can be any naturally occurring amino acid
  misc_feature (11)..(11): Xaa is Ala or Ser
  misc_feature (14)..(14): Xaa can be any naturally occurring amino acid
  misc_feature (15)..(15): Xaa is Ile, Leu, Val or Met
  misc_feature (17)..(19): Xaa can be any naturally occurring amino acid
  misc_feature (20)..(20): Xaa is Glu or Asp
  misc_feature (21)..(21): Xaa can be any naturally occurring amino acid
  misc_feature (22)..(22): Xaa is Lys, Gln or Arg
  misc_feature (24)..(24): Xaa can be any naturally occurring amino acid
  misc_feature (25)..(25): Xaa is Glu or Asp
  misc_feature (26)..(27): Xaa can be any naturally occurring amino acid
  misc_feature (28)..(28): Xaa is Ser or absent
  misc_feature (29)..(29): Xaa can be any naturally occurring amino acid
  misc_feature (31)..(31): Xaa is Ala or Gly
  misc_feature (32)..(32): Xaa can be any naturally occurring amino acid
  misc_feature (33)..(33): Xaa is Phe or Leu
  misc_feature (36)..(36): Xaa is Glu or Asp
  misc_feature (38)..(38): Xaa is Ala or Ser
  misc_feature (39)..(40): Xaa can be any naturally occurring amino acid
  misc_feature (42)..(42): Xaa can be any naturally occurring amino acid
  misc_feature (43)..(43): Xaa is Asn, Lys or Arg
  misc_feature (44)..(44): Xaa is Ile, Leu, Val or Met
  misc_feature (47)..(47): Xaa can be any naturally occurring amino acid
  misc_feature (49)..(49): Xaa can be any naturally occurring amino acid
  misc_feature (50)..(50): Xaa is Ala, Ser or Pro
  misc_feature (60)..(60): Xaa is Ile, Leu, Val or Met
  misc_feature (64)..(64): Xaa is Phe or Tyr
  misc_feature (65)..(66): Xaa is Lys or Arg
  misc_feature (68)..(68): Xaa is Lys or Arg
  misc_feature (69)..(69): Xaa is Glu or Asp
  misc_feature (71)..(71): Xaa can be any naturally occurring amino acid
  misc_feature (72)..(72): Xaa is Asn, Lys or Arg
  misc_feature (73)..(73): Xaa can be any naturally occurring amino acid
  misc_feature (74)..(74): Xaa is Asn or Arg
  misc_feature (75)..(76): Xaa can be any naturally occurring amino acid or absent
  misc_feature (77)..(77): Xaa is Asp or absent
  misc_feature (78)..(78): Xaa is Ser, Ala or absent
  misc_feature (79)..(79): Xaa is Lys or absent
  misc_feature (80)..(80): Xaa is Thr or absent
  misc_feature (81)..(81): Xaa is Cys or absent
  misc_feature (82)..(82): Xaa is Pro or absent
  misc_feature (83)..(83): Xaa is Tyr or absent
  misc_feature (84)..(84): Xaa is Phe, Tyr or absent
  misc_feature (85)..(85): Xaa is His, Gln, Asp or absent
  misc_feature (86)..(86): Xaa can be any naturally occurring amino acid or absent
  AT1G33240 (G634) clade Trihelix 2 consensus sequence
XSRWPKXEXXXLIXXRXXXXXXYXXXXXXKXXXWEXIXXXMXXXGYXRXXKRCKEKWENXNKYXXXVXXSXXXXXXXXXXXXXXXX

SEQ ID NO: 852 - protein, 64 aa, Arabidopsis thaliana
  misc_feature (1)..(1): Xaa can be any naturally occurring amino acid
  misc_feature (2)..(2): Xaa is Phe or Tyr
  misc_feature (3)..(3): Xaa can be any naturally occurring amino acid
  misc_feature (9)..(9): Xaa can be any naturally occurring amino acid
  misc_feature (15)..(15): Xaa is Ala or Gly
  misc_feature (21)..(21): Xaa is Ile or absent
  misc_feature (22)..(22): Xaa is Asn or absent
  misc_feature (23)..(23): Xaa is Gly or absent
  misc_feature (24)..(24): Xaa is Lys or absent
  misc_feature (25)..(25): Xaa is Leu or absent
  misc_feature (26)..(26): Xaa is Val or absent
  misc_feature (27)..(27): Xaa is gly or absent
  misc_feature (28)..(31): Xaa can be any naturally occurring amino acid
  misc_feature (32)..(32): Xaa is Arg or Lys
  misc_feature (37)..(37): Xaa is Ser or Thr
  misc_feature (39)..(39): Xaa can be any naturally occurring amino acid
  misc_feature (40)..(40): Xaa is Ser or Thr
  misc_feature (41)..(41): Xaa is Ala or Ser
  misc_feature (42)..(43): Xaa can be any naturally occurring amino acid
  misc_feature (46)..(46): Xaa can be any naturally occurring amino acid
  misc_feature (50)..(50): Xaa is Gln, Asp, Asn or Glu
  misc_feature (52)..(52): Xaa is Ala or Ser
  misc_feature (53)..(53): Xaa can be any naturally occurring amino acid
  misc_feature (55)..(55): Xaa is Ile, Leu, Val or Ser
  misc_feature (58)..(59): Xaa can be any naturally occurring amino acid
  misc_feature (62)..(62): Xaa can be any naturally occurring amino acid
  misc_feature (64)..(64): Xaa is Phe, Ile, Leu, Val or Met
  AT2G40350 (G1755) clade AP2 consensus sequence
XXXGVRQRXWGKWVXEIREPXXXXXXXXXXXXLWLGXFXXXXXAAXAYDXAXXAXYGXXARXNX

SEQ ID NO: 853 - protein, 64 aa, Arabidopsis thaliana
  misc_feature (1)..(1): Xaa is Lys or Arg
  misc_feature (2)..(2): Xaa is Phe or Tyr
  misc_feature (3)..(3): Xaa is Ile, Leu, Val or Met
  misc_feature (19)..(19): Xaa is Asn or Asp
  misc_feature (21)..(21): Xaa is Ala, Ser or Thr
  misc_feature (26)..(26): Xaa is His or Tyr
  misc_feature (35)..(35): Xaa is Asp or Glu
  misc_feature (39)..(39): Xaa is Ile, Leu, Val or Met
  misc_feature (43)..(43): Xaa is Arg or Lys
  misc_feature (47)..(47): Xaa can be any naturally occurring amino acid
  misc_feature (48)..(48): Xaa is Ile, Leu, Val or Met
  misc_feature (51)..(52): Xaa can be any naturally occurring amino acid
  misc_feature (58)..(58): Xaa can be any naturally occurring amino acid
  misc_feature (60)..(60): Xaa is Ser, Ala or Pro
  misc_feature (62)..(62): Xaa can be any naturally occurring amino acid
  misc_feature (63)..(63): Xaa is Thr or Pro
  misc_feature (64)..(64): Xaa can be any naturally occurring amino acid
  AT1G28160 (G2292) clade AP2 consensus sequence
XXXGVRRRPWGRYAAEIRXPXTKERXWLGTFDTAXEAAXAYDXAARXXRGXXARTNFXYXDXXX

SEQ ID NO: 854 - protein, 38 aa, Arabidopsis thaliana
  misc_feature (3)..(3): Xaa can be any naturally occurring amino acid
  misc_feature (6)..(6): Xaa can be any naturally occurring amino acid
  misc_feature (8)..(8): Xaa is Ile, Leu, Val or Met
  misc_feature (10)..(10): Xaa is Ile, Leu, Val or Met
  misc_feature (11)..(11): Xaa is Phe, Ile, Leu, Val or Met
  misc_feature (14)..(14): Xaa can be any naturally occurring amino acid
  misc_feature (22)..(23): Xaa can be any naturally occurring amino acid
  misc_feature (26)..(26): Xaa can be any naturally occurring amino acid
  misc_feature (28)..(28): Xaa is Ile, Leu, Val or Met
  misc_feature (30)..(30): Xaa can be any naturally occurring amino acid
  misc_feature (36)..(36): Xaa can be any naturally occurring amino acid
  AT2G21320 (G1881) clade BBX1 consensus sequence
CDXCEXAXAXXFCXADEAALCXXCDXKXHXCNKLAXRH

SEQ ID NO: 855 - protein, 36 aa, Arabidopsis thaliana
  misc_feature (6)..(6): Xaa is Asn or Lys
  misc_feature (7)..(7): Xaa is Ser or Ala
  misc_feature (14)..(14): Xaa is Asp or Glu
  misc_feature (15)..(15): Xaa is Thr, Ile, Leu, Val or Met
  misc_feature (18)..(18): Xaa is Ser or Thr
  misc_feature (23)..(23): Xaa is Ile, Leu, Val or Met
  misc_feature (27)..(27): Xaa is Ile, Leu, Val or Met
  AT2G21320 (G1881) clade BBX2 consensus sequence
CDICEXXPAFFYCXXDGXSLCLXCDMXVHVGGKRTH

SEQ ID NO: 856 - protein, 58 aa, Arabidopsis thaliana
  misc_feature (7)..(7): Xaa can be any naturally occurring amino acid
  misc_feature (21)..(21): Xaa can be any naturally occurring amino acid
  misc_feature (24)..(24): Xaa is Lys or Glu
  misc_feature (27)..(27): Xaa is Gln or Lys
  misc_feature (34)..(34): Xaa can be any naturally occurring amino acid
  misc_feature (36)..(36): Xaa is Ile, Leu, Val or Met
  misc_feature (37)..(37): Xaa can be any naturally occurring amino acid
  misc_feature (41)..(41): Xaa can be any naturally occurring amino acid
  misc_feature (45)..(45): Xaa is Lys or Glu
  misc_feature (48)..(48): Xaa can be any naturally occurring amino acid
  misc_feature (52)..(52): Xaa is Ser or Thr
  misc_feature (55)..(55): Xaa can be any naturally occurring amino acid
  misc_feature (56)..(56): Xaa is Gln or Glu
  AT3G57800 (G2144) clade bHLH consensus sequence
RGQATDXHSLAERARREKINXRMXLLXELVPGCXKXXGTAXVLDXIIXHVQXLQXXVE

SEQ ID NO: 857 - protein, 73 aa, Arabidopsis thaliana
  misc_feature (1)..(2): Xaa can be any naturally occurring amino acid
  misc_feature (3)..(3): Xaa is Phe, Ile, Leu, Val or Met
  misc_feature (4)..(4): Xaa can be any naturally occurring amino acid or absent
  misc_feature (5)..(8): Xaa can be any naturally occurring amino acid
  misc_feature (11)..(11): Xaa is Asn, Lys or Arg
  misc_feature (12)..(13): Xaa is Ile, Leu, Val or Met
  misc_feature (15)..(16): Xaa can be any naturally occurring amino acid
  misc_feature (17)..(17): Xaa is Gly or absent
  misc_feature (18)..(18): Xaa can be any naturally occurring amino acid
  misc_feature (19)..(19): Xaa is Asn, Glu or Asp
  misc_feature (20)..(22): Xaa can be any naturally occurring amino acid
  misc_feature (23)..(23): Xaa is Ile, Leu, Val or Met
  misc_feature (24)..(24): Xaa is Ala, Ser or Thr
  misc_feature (25)..(25): Xaa is Ala, Ser, Thr or Gly
  misc_feature (27)..(27): Xaa is Ala, Ser or Thr
  misc_feature (28)..(29): Xaa can be any naturally occurring amino acid
  misc_feature (30)..(30): Xaa is Ile, Leu, Val or Met
  misc_feature (31)..(31): Xaa is Phe, Ile, Leu, Val or Met
  misc_feature (32)..(32): Xaa can be any naturally occurring amino acid
  misc_feature (34)..(34): Xaa can be any naturally occurring amino acid
  misc_feature (35)..(35): Xaa Ser or Cys
  misc_feature (36)..(36): Xaa is Glu or Asp
  misc_feature (37)..(37): Xaa is Phe, Ile, Leu, Val or Met
  misc_feature (38)..(39): Xaa is Ile, Leu, Val or Met
  misc_feature (40)..(40): Xaa can be any naturally occurring amino acid
  misc_feature (41)..(41): Xaa is Glu or Asp
  misc_feature (42)..(42): Xaa is Ile, Leu, Val or Met
  misc_feature (44)..(44): Xaa can be any naturally occurring amino acid
  misc_feature (47)..(49): Xaa can be any naturally occurring amino acid
  misc_feature (50)..(50): Xaa is Ala or Thr
  misc_feature (51)..(54): Xaa can be any naturally occurring amino acid
  misc_feature (55)..(55): Xaa is Gln or Arg
  misc_feature (56)..(57): Xaa can be any naturally occurring amino acid
  misc_feature (58)..(58): Xaa is Ile, Leu, Val or Met
  misc_feature (59)..(59): Xaa is Lys, Gln or Arg
  misc_feature (60)..(60): Xaa is Arg or absent
  misc_feature (61)..(61): Xaa is Ser or absent
  misc_feature (62)..(62): Xaa is Asp or absent
  misc_feature (63)..(63): Xaa is Thr or absent
  misc_feature (64)..(64): Xaa is Leu or absent
  misc_feature (65)..(65): Xaa is Thr or absent
  misc_feature (66)..(66): Xaa is Lys or Arg
  misc_feature (67)..(67): Xaa can be any naturally occurring amino acid
  misc_feature (68)..(68): Xaa is Asn or Asp
  misc_feature (69)..(69): Xaa is Phe, Ile, Leu, Val or Met
  misc_feature (70)..(71): Xaa is can be any naturally occurring amino acid
  misc_feature (72)..(72): Xaa is Ala, Thr or Val
  misc_feature (73)..(73): Xaa can be any naturally occurring amino acid
  AT5G50480 (G1820) clade NF-Y_histone-like consensus sequence
XXXXXXXXIKXXXKXXXXXXXXXXXEXXXXXXKXXXXXXXXXTXRSXXXXXXXXXXXXXXXXXXXXXXXXXXX

SEQ ID NO: 858 - protein, 59 aa, Arabidopsis thaliana
  misc_feature (1)..(1): Xaa is Lys or Arg
  misc_feature (3)..(3): Xaa is Glu or absent
  misc_feature (4)..(4): Xaa is Ala or absent
  misc_feature (5)..(5): Xaa is Val or absent
  misc_feature (6)..(6): Xaa is Cys or absent
  misc_feature (7)..(8): Xaa can be any naturally occurring amino acid
  misc_feature (11)..(11): Xaa can be any naturally occurring amino acid
  misc_feature (14)..(14): Xaa is Lys or Arg
  misc_feature (15)..(15): Xaa is Ile, Leu, Val or Met
  misc_feature (18)..(18): Xaa is Asp or Glu
  misc_feature (19)..(19): Xaa is Asn, Lys or Arg
  misc_feature (20)..(20): Xaa is Phe, Ile, Leu, Val or Met
  misc_feature (21)..(21): Xaa is Asn or Lys
  misc_feature (22)..(22): Xaa can be any naturally occurring amino acid
  misc_feature (23)..(23): Xaa is His or Gln
  misc_feature (25)..(25): Xaa can be any naturally occurring amino acid
  misc_feature (26)..(26): Xaa is Asp or Glu
  misc_feature (29)..(30): Xaa can be any naturally occurring amino acid
  misc_feature (34)..(34): Xaa is Asn, Asp or Glu
  misc_feature (37)..(37): Xaa is Lys or Arg
  misc_feature (38)..(38): Xaa can be any naturally occurring amino acid
  misc_feature (42)..(42): Xaa is Ser or Thr
  misc_feature (43)..(44): Xaa is Ile, Leu, Val or Met
  misc_feature (45)..(45): Xaa can be any naturally occurring amino acid
  misc_feature (46)..(46): Xaa is Asp or Glu
  misc_feature (47)..(47): Xaa is Ala or Thr
  misc_feature (48)..(48): Xaa is Ile, Leu, Val or Met
  misc_feature (50)..(50): Xaa is Ile, Leu, Val or Met
  misc_feature (53)..(53): Xaa is Asp or Glu
  misc_feature (54)..(54): Xaa is Ile, Leu, Val or Met
  misc_feature (55)..(57): Xaa can be any naturally occurring amino acid
  misc_feature (59)..(59): Xaa can be any naturally occurring amino acid
  AT3G19860.1 (G782) clade bHLH consensus sequence
XKXXXXXXKAXREXXRRXXXXXXFXXLGXXLDPXRPXXDKAXXXXXXXQXLKXXXXXVX

SEQ ID NO: 859 - protein, 37 aa, Arabidopsis thaliana
  misc_feature (1)..(1): Xaa is Arg or Lys
  misc_feature (4)..(4): Xaa can be any naturally occurring amino acid
  misc_feature (6)..(8): Xaa can be any naturally occurring amino acid
  misc_feature (10)..(10): Xaa can be any naturally occurring amino acid
  misc_feature (11)..(11): Xaa is Gln, Asp or Glu
  misc_feature (13)..(14): Xaa can be any naturally occurring amino acid
  misc_feature (17)..(17): Xaa is Ala, Ile, Leu, Val or Met
  misc_feature (18)..(18): Xaa can be any naturally occurring amino acid
  misc_feature (21)..(21): Xaa can be any naturally occurring amino acid
  misc_feature (22)..(22): Xaa is Asp or Glu
  misc_feature (25)..(25): Xaa is Asp or Glu
  misc_feature (28)..(28): Xaa can be any naturally occurring amino acid
  misc_feature (29)..(29): Xaa is Ser, Ala or Thr
  misc_feature (31)..(31): Xaa is Lys or Arg
  misc_feature (32)..(33): Xaa is Lys or Arg
  misc_feature (34)..(34): Xaa is Thr, Ile, Leu Val or Met
  misc_feature (35)..(36): Xaa can be any naturally occurring amino acid
  AT3G19860.1 (G782) clade bHLH consensus sequence
XLKXEXXXLXXEXXELXXEKXXLRXEKXXLXXXXXXL

SEQ ID NO: 860 - protein, 38 aa, Arabidopsis thaliana
  misc_feature (2)..(3): Xaa can be any naturally occurring amino acid
  misc_feature (5)..(6): Xaa can be any naturally occurring amino acid
  misc_feature (7)..(7): Xaa is Tyr, Ile, Leu, Val or Met
  misc_feature (8)..(8): Xaa can be any naturally occurring amino acid
  misc_feature (9)..(9): Xaa is Ala or Pro
  misc_feature (10)..(11): Xaa is Ile, Leu, Val or Met
  misc_feature (12)..(12): Xaa can be any naturally occurring amino acid
  misc_feature (14)..(14): Xaa can be any naturally occurring amino acid
  misc_feature (15)..(15): Xaa is Ala or Thr
  misc_feature (16)..(16): Xaa is Asp or Glu
  misc_feature (17)..(17): Xaa is Ala or Thr
  misc_feature (18)..(19): Xaa can be any naturally occurring amino acid
  misc_feature (20)..(20): Xaa is Phe, Ile, Leu, Val or Met
  misc_feature (23)..(23): Xaa is Ser or Thr
  misc_feature (26)..(28): Xaa can be any naturally occurring amino acid
  misc_feature (30)..(30): Xaa can be any naturally occurring amino acid
  misc_feature (31)..(31): Xaa is Ala or absent
  misc_feature (33)..(33): Xaa can be any naturally occurring amino acid
  misc_feature (34)..(34): Xaa is Ile, Leu, Val or Met
  misc_feature (35)..(37): Xaa can be any naturally occurring amino acid
  AT1G60250.1 (G1486) clade BBX consensus sequence
CXXCXXXXXXXXCXXXXXXXCLXCDXXXHXXNXXXXXH

SEQ ID NO: 861 - protein, 222 aa, Arabidopsis thaliana
  misc_feature (2)..(2): Xaa can be any naturally occurring amino acid
  misc_feature (15)..(15): Xaa is Phe or Tyr
  misc_feature (16)..(16): Xaa is Ile, Leu, Val or Met
  misc_feature (18)..(18): Xaa is Asp or Glu
  misc_feature (19)..(19): Xaa is His, Lys or Arg
  misc_feature (20)..(20): Xaa is Asp or Gly
  misc_feature (21)..(21): Xaa can be any naturally occurring amino acid
  misc_feature (22)..(22): Xaa is Ile, Leu, Val or Met
  misc_feature (23)..(23): Xaa is Ala or Thr
  misc_feature (24)..(24): Xaa is Ile, Leu, Val or Met
  misc_feature (26)..(26): Xaa is Phe, Ile, Leu, Val or Met
  misc_feature (31)..(31): Xaa can be any naturally occurring amino acid
  misc_feature (47)..(47): Xaa is Thr, Ile, Leu, Val or Met
  misc_feature (48)..(49): Xaa can be any naturally occurring amino acid
  misc_feature (54)..(54): Xaa is Ile, Leu, Val or Met
  misc_feature (58)..(58): Xaa is Phe or Tyr
  misc_feature (60)..(60): Xaa Ala, Ser, or Gly
  misc_feature (61)..(61): Xaa can be any naturally occurring amino acid
  misc_feature (65)..(66): Xaa is Ile, Leu, Val or Met
  misc_feature (77)..(77): Xaa is Ile, Leu, Val or Met
  misc_feature (78)..(78): Xaa is Asp or Glu
  misc_feature (81)..(81): Xaa can be any naturally occurring amino acid
  misc_feature (87)..(87): Xaa is Asn or Asp
  misc_feature (89)..(89): Xaa is Ala, Ile, Leu, Val or Met
  misc_feature (95)..(95): Xaa can be any naturally occurring amino acid
  misc_feature (97)..(97): Xaa is Ile, Leu, Val or Met
  misc_feature (103)..(103): Xaa is Ala, Ile, Leu, Val or Met
  misc_feature (105)..(105): Xaa is Gln or Arg
  misc_feature (106)..(108): Xaa can be any naturally occurring amino acid
  misc_feature (109)..(109): Xaa is Asp or Glu
  misc_feature (110)..(110): Xaa is Asp or Asn
  misc_feature (111)..(112): Xaa can be any naturally occurring amino acid
  misc_feature (115)..(116): Xaa can be any naturally occurring amino acid
  misc_feature (118)..(119): Xaa can be any naturally occurring amino acid
  misc_feature (120)..(120): Xaa is Ile, Leu, Val or Met
  misc_feature (121)..(121): Xaa is Thr, Ile, Leu, Val or Met
  misc_feature (122)..(123): Xaa can be any naturally occurring amino acid
  misc_feature (127)..(127): Xaa can be any naturally occurring amino acid
  misc_feature (128)..(129): Xaa is Ile, Leu, Val or Met
  misc_feature (130)..(133): Xaa can be any naturally occurring amino acid
  misc_feature (134)..(134): Xaa is His or Asp
  misc_feature (135)..(135): Xaa can be any naturally occurring amino acid
  misc_feature (136)..(136): Xaa is Ile, Leu, Val or Met
  misc_feature (137)..(137): Xaa is V or absent
  misc_feature (138)..(138): Xaa is Asp or absent
  misc_feature (139)..(139): Xaa is Ile, Leu, Val or Met
  misc_feature (140)..(140): Xaa can be any naturally occurring amino acid
  misc_feature (142)..(142): Xaa is Ala or Gly
  misc_feature (143)..(144): Xaa can be any naturally occurring amino acid
  misc_feature (145)..(145): Xaa is Thr, Ile, Leu, Val or Met
  misc_feature (146)..(146): Xaa is Phe or Tyr
  misc_feature (147)..(147): Xaa is Gln, Arg or Lys
  misc_feature (150)..(151): Xaa can be any naturally occurring amino acid
  misc_feature (153)..(153): Xaa can be any naturally occurring amino acid
  misc_feature (156)..(157): Xaa can be any naturally occurring amino acid
  misc_feature (159)..(163): Xaa can be any naturally occurring amino acid
  misc_feature (164)..(164): Xaa is Ser or Pro
  misc_feature (165)..(165): Xaa is Ile, Leu, Val or Met
  misc_feature (167)..(169): Xaa can be any naturally occurring amino acid
  misc_feature (171)..(171): Xaa is Asn or Asp
  misc_feature (172)..(172): Xaa can be any naturally occurring amino acid
  misc_feature (173)..(173): Xaa is Asn or Asp
  misc_feature (174)..(174): Xaa is Ala or Thr
  misc_feature (175)..(175): Xaa is Ala or Ser
  misc_feature (177)..(177): Xaa can be any naturally occurring amino acid
  misc_feature (178)..(178): Xaa is Ile, Leu, Val or Met
  misc_feature (179)..(179): Xaa can be any naturally occurring amino acid
  misc_feature (181)..(181): Xaa can be any naturally occurring amino acid
  misc_feature (182)..(182): Xaa is Ala, Ser or Thr
  misc_feature (184)..(184): Xaa is Ile, Leu, Val or Met
  misc_feature (186)..(186): Xaa can be any naturally occurring amino acid
  misc_feature (187)..(187): Xaa is Ala, Ile, Leu, Val or Met
  misc_feature (188)..(190): Xaa can be any naturally occurring amino acid
  misc_feature (191)..(191): Xaa is Tyr or absent
  misc_feature (192)..(194): Xaa can be any naturally occurring amino acid
  misc_feature (196)..(196): Xaa is Ser or Gly
  misc_feature (197)..(197): Xaa is Ser or Ala
  misc_feature (198)..(199): Xaa can be any naturally occurring amino acid
  misc_feature (201)..(202): Xaa can be any naturally occurring amino acid
  misc_feature (205)..(205): Xaa can be any naturally occurring amino acid
  misc_feature (207)..(210): Xaa can be any naturally occurring amino acid
  misc_feature (212)..(212): Xaa can be any naturally occurring amino acid
  misc_feature (214)..(214): Xaa is Ile, Leu, Val or Met
  misc_feature (215)..(215): Xaa can be any naturally occurring amino acid
  misc_feature (216)..(216): Xaa can be any naturally occurring amino acid or absent
  misc_feature (218)..(218): Xaa is Lys, Glu, His or Gln
  misc_feature (219)..(219): Xaa can be any naturally occurring amino acid
  misc_feature (221)..(221): Xaa is Ile, Leu, Val or Met
  AT1G29470.1 (G837) clade methyltransferase domain consensus seq
VXLDVGCGVASFGGXXFXXXXXXXSXAPKDXHEAQVQFALERGIPAXXXVMGTXRLPXPXXVFDXXHCARCRVPWHXXGGXLLLELXRXLRPGGXFXWSATPXYXXXXXXXXIWXXMXXXXXXMCWXXXXXXXXXXXXXXVXXXXXXKPXXNXCYXXRXXXXXXXCXXXDXXXXXWXXXLXXCXHXXXXXXXXXRXXXXPXXWPXRXXXXPXWXXXSXXGXY

SEQ ID NO: 862 - DNA, 1009 bp, Solanum lycopersicum
  RBCS3 (Ribulose 1,5-bisphosphate carboxylase, small subunit 3) leaf-specific promoter
aaatggagtaatatggataatcaacgcaactatatagagaaaaaataatagcgctaccatatacgaaaaatagtaaaaaattataataatgattcagaataaattattaataactaaaaagcgtaaagaaataaattagagaataagtgatacaaaattggatgttaatggatacttcttataattgcttaaaaggaatacaagatgggaaataatgtgttattattattgatgtataaagaatttgtacaatttttgtatcaataaagttccaaaaataatctttaaaaaataaaagtacccttttatgaactttttatcaaataaatgaaatccaatattagcaaaacattgatattattactaaatatttgttaaattaaaaaatatgtcattttattttttaacagatattttttaaagtaaatgttataaattacgaaaaagggattaatgagtatcaaaacagcctaaatgggaggagacaataacagaaatttgctgtagtaaggtggcttaagtcatcatttaatttgatattataaaaattctaattagtttatagtctttcttttcctcttttgtttgtcttgtatgctaaaaaaggtatattatatctataaattatgtagcataatgaccacatctggcatcatctttacacaattcacctaaatatctcaagcgaagttttgccaaaactgaagaaaagatttgaacaacctatcaagtaacaaaaatcccaaacaatatagtcatctatattaaatcttttcaattgaagaaattgtcaaagacacatacctctatgagttttttcatcaatttttttttcttttttaaactgtatttttaaaaaaatattgaataaaacatgtcctattcattagtttgggaactttaagataaggagtgtgtaatttcagaggctattaattttgaaatgtcaagagccacataatccaatggttatggttgctcttagatgaggttattgctttaggtgaaa

SEQ ID NO: 863 - DNA, 1714 bp, Arabidopsis thaliana
  RBCS4 leaf-specific promoter sequence
caaatttattatgtgttttttttccgtggtcgagattgtgtattattctttagttattacaagacttttagctaaaatttgaaagaatttactttaagaaaatcttaacatctgagataatttcagcaatagattatatttttcattactctagcagtatttttgcagatcaatcgcaacatatatggttgttagaaaaaatgcactatatatatatatattattttttcaattaaaagtgcatgatatataatatatatatatatatatatgtgtgtgtgtatatggtcaaagaaattcttatacaaatatacacgaacacatatatttgacaaaatcaaagtattacactaaacaatgagttggtgcatggccaaaacaaatatgtagattaaaaattccagcctccaaaaaaaaatccaagtgttgtaaagcattatatatatatagtagatcccaaatttttgtacaattccacactgatcgaatttttaaagttgaatatctgacgtaggatttttttaatgtcttacctgaccatttactaataacattcatacgttttcatttgaaatatcctctataattatattgaatttggcacataataagaaacctaattggtgatttattttactagtaaatttctggtgatgggctttctactagaaagctctcggaaaatcttggaccaaatccatattccatgacttcgattgttaaccctattagttttcacaaacatactatcaatatcattgcaacggaaaaggtacaagtaaaacattcaatccgatagggaagtgatgtaggaggttgggaagacaggcccagaaagagatttatctgacttgttttgtgtatagttttcaatgttcataaaggaagatggagacttgagaagttttttttggactttgtttagctttgttgggcgtttttttttttgatcaataactttgttgggcttatgatttgtaatattttcgtggactctttagtttatttagacgtgctaactttgttgggcttatgacttgttgtaacatattgtaacagatgacttgatgtgcgactaatctttacacattaaacatagttctgttttttgaaagttcttattttcatttttatttgaatgttatatatttttctatatttataattctagtaaaaggcaaattttgcttttaaatgaaaaaaatatatattccacagtttcacctaatcttatgcatttagcagtacaaattcaaaaatttcccatttttattcatgaatcataccattatatattaactaaatccaaggtaaaaaaaaggtatgaaagctctatagtaagtaaaatataaattccccataaggaaagggccaagtccaccaggcaagtaaaatgagcaagcaccactccaccatcacacaatttcactcatagataacgataagattcatggaattatcttccacgtggcattattccagcggttcaagccgataagggtctcaacacctctccttaggcctttgtggccgttaccaagtaaaattaacctcacacatatccacactcaaaatccaacggtgtagatcctagtccacttgaatctcatgtatcctagaccctccgatcactccaaagcttgttctcattgttgttatcattatatatagatgaccaaagcactagaccaaacctcagtcacacaaagagtaa

SEQ ID NO: 864 - DNA, 1923 bp, Arabidopsis thaliana
  At4g01060 (G682) promoter sequence
ttattaagtgctatgcgttaatcggcatctataaagtgttgcattgatgaacaaagtggatgcctaaactagacgtttaactaaatgtttagaatgaaatcttcatctcatctaaaaagtgttgcattgatgtaaaaagtggatgcccattagttcttggctttgaaatgtttttagaatgaaatcttcatcaatctccatatgtggttcaatccactcattttatcttttgttaaagatgttcttcaggccaatataatgatgaccatggatggtttgcaactcgcatataacacttctttatccgatggttacaagtattacatggctatagatagcttttgcatgcaacaaattatctatcaaagtttatgcatcctctaaaatatggtcattggcaagccactaaacgtatatattgtgacaatgtatgatgatatatttttatgtgttgactccgtttttcattaagtaatgaaacatgttgctctagattaccattttaatcgcaaacatatatgttgctctaccacgcattgcatcaaatgataagcttgaggacgcttcgacaaaaacatatttctccttcttcttactgaaccaaatgacaattgacaaaccccattaataaaatcggttagtgttaatgtgtcactcataatattaacttagtaaagaacaagaccacattaattaaatcaggtgttagtctgagaatatacgtttctcttcctcattccaaacttaaattcggaatttactgagaatatattgttagcactgaaaaaggttaagttgaaagtttgctagggatggcaattaaatatagtcttgccttggggatattcccttcgtggacttgtaagtttatttataggtcctcttatgtatatatagatgatctaacgatcgatatactatgaaaaaagttgttactagattttattgcaggtaatagtgttgaataacccgaaccaataaagcagttgtaacgaacacacgacacgttgcttactgcgaggaccactttgttttttgttttttttggctttaagccaatttaggaccaaatttgcatgattgaggatgcaagtatccaacccattttcatctttcgtagtgacactcatttacttttgtgatggacacgttatagtatatcttaaatattaaagagacatgattgggggatcattgttttaatttaaataatgtagattctattcttttcatggtattaatccaatttatagaaagttatgtgttattagcaattaagctaaatgatgaaaacaatcagtttagtgaaacaaactcgccgagaaaacatgaatggttgaaaatattattgtgttttacaaacgtacacgaggacaatagttttgtaagtttttcttaggcattgaaaaatgtttgatacaaaaagtaatgttaaaataattaaaaatgattttgtcttaatatatccaaaatttcaatctattatgaacaaagggagtataatttctgattgaatgaactggaatagcaatcagaaaagctttgaaaacaattgttgttgattattaatgatcttaattaacggcatgtatcaatatttatacaacttatgttccagtccaagccatcacaacggagtaaatgaagtcacgggtacttgtggtttttattggttgcaaacttgcaacttgcaaagatagctaacaataattaatataattaatgagaacaaaaccaatttagtaaattaaaatcctttaacatagaaaccgaccaaacccgttggaccgttggttacttgatttggttagttgctataaatagaaatgatggttcgtgtgcaaccttcaaaatacgaccactctctcagagtactctcttagtttctttcttcttcttctttgtaatacggtgccgtttgac

SEQ ID NO: 865 - DNA, 1500 bp, Oryza sativa
  Os02g09720 location: Chr2:4997678-4999177
ggccgtcgtcggcgagttctcagctatagcttggtagctatctagctcaatttgctgtctccaagtgtgacagctagttgtaattgagttggtatagctttggcctcttcttttatttttttcaggccgtttagatggtaacctctctgacttgagagagttagagaggccttgtatatacggagtatatagtactccagtttagttgccatgccagcagttgcatgcactagtaagcaactagtctctcggtttcatattacaactcgttttaactaagtttatagaaaaaacatagtcgtatttttaatacaaaacaaatatattatcaaaatatatttaatgtttggtttaattaattaacattggtgtttttgatgttactaattttttttataaacttagttgaacttaaaataaattggttaagaaaaagttaaagcgacttgtaatatagaacggaggaggtagctattggtcaaggggatgtgcatccatgtttggtaggtagccgtggtggctttggtgtgtcattctctatcttttccacacacacactttaaatttgctggctttttagaagaacaatggtaatgtttcgcttttattttgctcatggtaaaaagattgtgtttcgcttttcgaggggcaaaaattaagtctaattgatgctattgattaataagatcgtgatcgcgaggaggattgagatgtctcgatggacataatagaatcttaggttcaaggaatttacactctttaataaagacttcgcttgcaaagatgtaggccaaatgaaagagacttaagcatgcttgttgatataatactagtttattttgagaattaggatttaatttgatgcactaaacctagagtaaaaaccataagatgacctaaatctgtgccaatatatttctagttggttcataattaatcaacggaatgagtatgcagtttttctcttaaaatgcctataggagttaggtgccatgctacaccacactactgaaactgaattggtgccggttggaaaccggctatagatgtcggatatcctaactgatacccagtagacgacacctttggcttcagtcatcgatcccgccggcatcttttacttacaaaggtgtcggttttgaatacagaaccaacacctatactgtcatataggtgtcagttcttaaattgattggcgtatggacagttttacatgtgacttttacaggtgacagttcgtaaatacaactggcacctataagaagcatatatgtgccatttgtacaccgggcaggacacgggacaagggttataggtgtttgtttgtaagtaaaaccagcacctatatgttagcaagaaaaaaaataaaaatgataggacctaccaatttcacatacatatcacacaataacagaaattcacatcacttcaaacatacaaccacattcacattcaaccaaactatatatattcaattccacatccacaaccctcatccca

SEQ ID NO: 866 - DNA, 1500 bp, Oryza sativa
  Os05g34510 location: Chr5:20455817-20457316 (reverse complement)
ctatatcttcctacctatccccctgcaagctaacaaggggaattacttgcacatctaatgatggactggtgttgttatgcggttgtgttggggtgagatggaggatgtctctcctcccccttgctagcctttaaaaaggagtcctacaggggcataacaggaatgagaggaagcttctggagatcaattctcacaacacacatttcctacagtacagttttgcccccagacagatcggatggtgtgtgtcagcagcctctatgcctgtaggcatgcattcagttgaatggttttgtctcgatcgacggcgaaaaaggatttacttttggacaagaaaaaagagcctttaatccatgagattactacatctcgcatacagggacaagtattacagctgtgagtgatgcttaagagactttacggttttgtttgcagctaagcaggaattaatataaataatctcccttttcagggctctgcttgcatgaatagctaccagccagagccaagagtgccagagacatcaagcctggatggtagtagtacagtacttgcgttactcgtgcccggcgttgctgcttcggtggggcccacttgaactggccgtcctcccgagccgtcggtgggggtggtccccaccaccggccagttactttgctcccgtcgattcggcccggtgcaccaacagcccatttttttatgatgggcttgcaacttggcccaacttgttggattgtcaaggccggagggaggcccatctgggcgaacttgtgtgggccgcttctttccattttagagaggaaacatgggctgggctacgggctgcgggctgccacctatcaccggagaaacacttgctcgcagcctcaaatacttgaaaccaggctttgaaaattcggcaaaaatcatcaaacctccgaaagtatgagagaggaaaatcaattatgatcttcctaattgtgtcatgattagcatagcgcatcaaagcaccttatcggtgcaaaattaatccctttcaaaaccattgtacttcatgaatcttgctacatatcttaaaaacgttgacgggcttacagcttaccagagatcaaagcgagaggcagaacaaagttcaaaatctgccgtgtataacaacaacaagtaattacagtagaaacaccttactactcatcaatcactactactaacaccaccacatacgaatcatttctaccagatccaaacaaagaaaaaaaaagagggagagagaactaattaaaaacacgaaatccgaaccggttcaactaatcaatcttcgccacaatctccagctccagcgatgaactgatgatcatggcggccaccaggtcaggtgtatgtattcacaggtttcgccgcgatttgacatgattggaagtggaacgcaaactcacgcggccactccggcgccggcgccgatgcaggagaagacgcggacgctgcgggccttggggagcgctacccgcggcagccgccggccag

SEQ ID NO: 867 - DNA, 1500 bp, Oryza sativa
  Os11g08230 location: Chr11:4325545-4327044
cgccgtatccaccttcaccagctcgatctccgtcgttgatcgttgattgattacgtactacctgagtgatgatggacgtggatcactggaatgggttgagaaaataaaaatgatttatgtagtgtgtaggagtactcaactaacaattgaacgaccagaatttgacgaattttatttacatgtttagagaccctgggtagagattcagtaataattaagttcttgccatatttttgcatcaatttaattattttactaaaatgatttatgttgttttattttcttggcactatatttgcatcaaatataattaaacttagcttaactggccagagcttatatatggctcagatttaattcccctcttatcttcagagcattaaaaagggagtatcctaaaatacctatctcctaaaagatcaatctgcctgtggctcaaatctatataaagtgagctcccctcccactgtcccacatatctatatagctaccatggcactacagcttgcaacacgctcaaggaagtctctcgccatcgccgtcgccgccgccgtgccgctgctgatgtgcctcttcctcgtcgccgccgccgccgcggctgcatcgtcggagacggcggtggcgagctccccacagtaccagccgagctatggtaatacgtactcgacgtgcttcgaggtttcggcatgcgatgacaccgggtgcgcgatcaggtgccgcgacatgggtcacaaccctgctggctcagcctgctggaccagcaacgtcgcgaccatcttctgctgctgcggccgtggtcgtcctcctccggttgcttgatccatatgtatacataattacatatatggtatatgtataactggataataaagcgtatgtgcgtgtcagcgtgagttggtgaagatgacttataacatgaaacaggagtagcgctagtaatgagatgtgtgtaaaaatgttatggttcaattaattaatcaaagtcgatctttgcattgcatgctgatacatatctatcgaaatatatatgtactaagaccaagaatcaaagtcgtactactcgtatatgtacaaaataattaattttaggcaaattttgctacaggacaccgtaattgtgtggttttagcctagggacaccgcaaaaacaaagtttgaggaaagacactacgtaaccgtggatatttgcgatggacaccgcaccgtctaaacgaaacttgctatgctgacgtggcggtcgggagccccttttttgacgcggtcggaccgaaatgcccctgcaccttacctcctcatattgcttgctggacactaaattgtttgctggacactaaatacatagatagatacatcgtacatatacatgacagatataccgacatggactacgttccttctagccaccgctgccggcgagctccaccgccgtcatatggttgttgcgcctggcgtgagaggtatatgcggcattgcatcactgtccggccaactttgaattaa

SEQ ID NO: 868 - DNA, 1500 bp, Oryza sativa
  Os01g64390 location: Chr1:37374848-37376347 (reverse complement)
tgtccagggctccaggccgtgatcagcgctcgctgctacgctcagaccaacacaggaaattattacttgctccctactactacgtgcaagcagcgtaaagggggcaggccactgtttgaaattcatccctctcaccttttgaaacagccgcgcgtcgtgccgctgtagtagtgcagctgtgcaggtgcagtagctttgggtcaaaactcaaaactcgaaagggagacagcaccaaaaagatactgcggctgcagccacacagggctagctgcttgacgcagagagttcgtagcgacgttgctcgtctgggcatggcagtcgcgcctagatcggctcgtgcacggcatgcgttgcttgcctgggtacgccaccacctgcgcagccagcgatcatggccggcgcggcgtcccacggcacgagagcgagcgcgcgcgcgcgcggcactctcgtgaaggcgtacgcgccatccggccgcgcggcgcggcgcaggccggtgcagcgtgcaggttgacccgcgacaggcgcacggccgcacacgcggtgcggcgggccggcggcctggatttgggcggagttctcggtggccgtcgcttttcccgtgccagctgacgcgattacgagccgtacccgatcaaaaccggcgtgatcgccggtccgatgcatgcgttttgttttcatgccagatctttggtaatcgttagtacgactctctgagtccgcgagtacgctggtttctgttaattgcagcctacagtattttctttttcttttttgcctcggggaagcgatgcgagcgatacgtgataatttcaggtggcgcagtgccgctgtgcatgtgtgaaatcatgcaagattggcaggttgctagcgcgcacgtactcctctctggtgtgatcggtttcaggtgatagagacgatacatgggcataccttgacacggagtgggctgggatggcgcgggtggtccatcggctacagccttacatgctcctcctatcaaactctcgttatgtccagttcacttggcccatccttggtttcctctacgactagtgctcctctagccagtagccactacccactgtttccatattggcgcacgggtcatataagatggtttgttcctgttcacctgacgggaaattctttctcctaaaacgatatcgaaccatccttatccggattggattaacgagatcgtcgtgctaagtgtgctaacacacttgttatatgaccgttattccgagttcgtcttgctgctgggagagttgcagaattgtagtactcccttcgtttcatgtgacaagacgttttgactttagtcaaaattaaattgctttaaatttgattaagttcgtaaaaaaaagtactacctccgttttacaatgtaagtcattttagcattaacgagcatggtggctcgcgcaaattgcgcggctagcatcattatattttctctcatataatagcatatatgttttctcattatattattcaaat

SEQ ID NO: 869 - DNA, 1500 bp, Oryza sativa
  Os06g15760 location: Chr6:8954266-8955765 (reverse complement)
ctccggcgaggcggtggactcggactccgactccgacgaagtcgaagagatgatcgaaaggtttgggagtcgcggcggcgaggatgaggggggtggatttggtatatttacgggcgcgggtttgggctttttttcgcgaatgggccccgcccggtttgacttctgcgatagggatgcccctcaaaaggtagaaaaatactcaaagaaatactcctaactccgtttctaaatataagtgatatatatatactactcaatcccttttagattggaagatgttttaactttgaccaaagtcaaactactctaaatttaactaactttgtagaaaaaattagtaatatttataacactagcatagtttcattaaatctataattgaataaattttcataatatatttgtcttgggttaaaaatattactattttttttacaaaattagtcaaacttagattagtttaaatttgaccaaaatcaaaacgtcttgtaacctgaaacggagggagtatttcttttagctggagaataggtgaaactatccctcttcaaaattttaaccagtcggatttttataaaaaaaaatattttcaaatattttagacaagcatattaccaaattatattgcatcttaaatatataaaagtattgcgaagtggtgctatactttttggcgcaaaaaaaaactcaaatacttcacatccctttttatataagggaaactttcttttactgaaataaataataagtgaaactatttatctttagattttagccactcgtattttttagactgatgccacttatttttctaaacaaggttttcaaatattcaaaacaatattattctcaaattataaaagcttgaacctttgtttatcgtaatacaaccatgtaagaaatttttagtggtgaaaacgaaaaattgtccagccaaatacatgtcatcttcacatcttctactagtttgatccacctttggtgtttaatgttttcacaaaaggagtaagatactacgtcgcacaattttggaatcagttgttggaaataatttattctattttggatggcataatactttcagactttcattatagaatttactatatgatcattttttttatatttcagctggctatcatttgaagggatgggtgaatttatcccatgacattaatcccccccctccccctaaatttttataacttatcggctgtgtcttttatataccacagatatgaatcagttttcatcattattaaaaaaaatcaagacaattattttaaaacaatatttagcgcggagattcgtgctgggtcgtccacgtatgcagcatgggtgtcgctgtggggggtttggtgattgctggtcgttgtcgtttcgtggccggttgcagtttgtagccaagggtggtggcatctgatatctggccacacactttggttatggaatgctgggtttgctgctggtgtggtgatcaaccggtgggtgattggtttg

SEQ ID NO: 870 - DNA, 1500 bp, Oryza sativa
  Os12g37560 location: Chr12:23047433-23048932 (reverse complement)
tgacggcgtctccttcttcttgcttcttgcttcttcttcttcctcctcccgatctggggttgtaggaagctactggtcgtgatcaatggagcattccgccatggatggattggatgggatggggagaaggggagggggagaagcgcgcgttgctggcgatgttctctccgcgtggggggtgggatgcgatgcgatgcgatgcggaggaggaggaagacgacgaggactcggctagtctggagttaattgattaattaattgattaattaggagcaggagaagtgcaagcacgacgagagtgaagggaaaggaaccgccgtttcaaaaaagatggaatttttgcggccaaccccttctactagtgacgaatcacggtcatgtttgccacaactttcaggctgagttcgtttctttgatactccattcgtaccgtaaaaaaccagcctaatactagatgtgacacatcatagtattacgaatctggagatacctctgtccagatttattgtactcgaatatgtcacattcagtcatatattcgttttttttggacgggggagtatctaattcactcctcggctaatgattaattaatcatgtactaatggatcactctgttttccatgaacacagcctcgggttaggtcttagatccacgacagatttaaatttttaagttttatttaaaatatgtgtaaaatgatttatccaaatgttatagacataattgaggatctaaatacatggatttgtggagcttgaaatattcagcttctaaaaatcttgaatttggagctatgctaaagaggacctacgtatcctgcagttaacttattccaaaaagaaaaacaatatccaaacctgatgcttaaaaaaacacactgaaaattaaaggcgttatataaaaagtatatataaagtattaaacttgacaaaatgtgttggagaaaccatgcgtaaaactccagatattacctggagacaaaagggcatgtagtcaatgattgcaaaacaaattctctggaagtaacggaaataattgaaagttatacatatccaagtaggatttactacttacatagccagccattatccactgataattgctgctattatcaccataatcaaccgaataatcagccaagaggttatcccaacgataaatgactttgatctctcctttggtttaactcaaatgaatgataatggcttatcaaatgaccagtcatcttgactacaaaatcatatgataattaacctcattaatttatcactagtggctgataaaatgggatatagagaatgctttggaattcatgatatttgctaatttataggtaaatttctaacaaacatatggtaaaataaacccccataataatcgtactaccaaactataccaaacaagtactcttagcatgtatatatagccacaccgatcaactagaagactcaaaataccaataggttgtcggcatcgcctaaccgtgatcagacatc

SEQ ID NO: 871 - DNA, 1500 bp, Oryza sativa
  Os03g17420 location: Chr3:9689781-9691280 (reverse complement)
gtgttcgcacgacgatagggctctgacttcttatggaagatgaacatgataaacgtagatgccttttcatatagtacgacctacctgaagacatgagatgagatttattagacgttttgctggtcaacacacaacacgtcgatgactcgtgcgacgcaaatgcaaatccagatgagttagtggaccctcacacttatacataggagtaggtgtcatctgagtcaatatactagcaagagtgagtttgaaagagatgttgggattgagcttttttttagcacatataaaacgagataagtcattactatatgattaattaaatattagctattgcaatttgacttctatgtaaaaattttttttcaaaaacatatacattagtttgcaaagcgatgaaatagtttacccaacttctctttagaactcagcctaaataaatctaacccctaaatatgctaaatgtgccagccctagtccaaaatttaatgagacctaccataagaatgttgacatgacatcttcaccaatcctacaaacccttaaaaagttaaaagtttgaagaaagttggaagtttagaaaaaaagttagaagtttatgtgtgtagaaaagtttttgatgtgatatgatgtgatggaaagttgggaatatgggggaaactaaatacggcctaacaagtatggcacacacacgctttatttttaccttttttcttctttttattctgtctttcattctccttttctatttctttgcttctatgttcttcctcaagcgagccttccttgagctcaagttgttgccattgagctcatggtgggctggtgggcatagtcgtgcactcacactaagcaactatcgttaagctttccatggctgctgtaacatcccggcccagggcttaataggattaatataagacttgtgcacacgagtgaggacaaagtgtgcagaaaagacttgtgttggtctgtgagggcagtctatgacctatgaaagctgccagatgtaagcggaccacttcttttctggaagccgatgtccaaagaactttagggttaagcgtgcttggcctggagcaatttgggatgggtgaccgaccggaaaattcttcccaggtgcacacgagtgaggacaaagtgtgcatgaaagctgccagatgtaagcgggcccagcttgggagaggcgggacgttacagctgcgatgcttaagcgtccctatcggccgccaccatcgagctcgtcctacccttggtcaccaccactcctctaccatcactgagctcctatgcatccacggccaaaacaaaaaccctatccttacgtatctcctctttcaccaaccgaaacccaccctagcctccattgcttcagtcaccgccattaaacaatattagatcgaaatcctaattcttcgccagcacaaaatgactaaattcattagtgttgcttctcatgttccaaaattaaacatgtatacgagttcattgtacccggtaatc

SEQ ID NO: 872 - DNA, 1500 bp, Oryza sativa
  Os04g51000 location: Chr4:30185779-30187278
gcgaggatggctactagcttgctgtccttgcggtcggccgggctcggtttctccggttgtttcttgtgtttcgcccacacacctctgtgcgtcgcgttgggctcgttatatagcggccactgtagtgttgggctatagttgctgcacgcggttgacttgacaaatctccatagctcgttgcattggtccggatcgatgtatctgcattcacgctagcttttggtttttgtccaatacttggaggaagggagcgagctaccgatcgatactacgtgaaaacgacctgtcctgtagaaagctgcatgcgtcgctagagcacacacgatttgatagtctagattctagtaagccctattacgtgccggtacataaaaagtaggcacagtaagccttataggagtaatacacccacacattgtgttgtcctgtcacggcgtacgtgcatttgtaatgtggcgcacgtctcaagtgtccttcgatcttttcgtcccgtctctccttggaggtagcaacggcgtcactgttcctcttccgaagaaaaaagatactcctgcatgcgtactgttgttgcgtacacggtgaacacgggtgaggccgtagccttgtgcccttaattatcgtacgtggcggttgtccatgtaatcgtgtgagcggtgggggcagaagattagcgtgtcattctgcagattttccccacgctagggcaactcaaaaatgtttttgattccgagggcgaaaatatactttttaagaattattttaccattctggataattaatgtatcgagagacaccgtatttttttaatataaaacttaatacttttagatactgtgtattttgagataaacaaaagagtaaattgcatcagcggtacacgaacttgtcaggttggtgcaatctagtacatgaacttctaaaacgctcgtttctgtgcacgagcttgtttgatgcgtgcgaataatgtcaaaatcgcactgcaaggttaatcttgttgattctgtggttgatttaaactctatgtaaacattagtctaagaaggataaacatataataaggcataatgattgtataaaaaaataaaaatttgagtaatgatgcaagggacagaaacaaagaaagataaagtggaatctaagaaaaatcggtcttgtcgcaccattttagtcttagtttgcacataccagacaaattcatgcaccaaaacgagacgagcattttataagttcatacactaaattgcacgcacctgacaaatttatgtaccgctaatataatttactctaaaaaatgtagtgtaaaatttctcttcttttaaagtctcactatggtgcattcattggtcttatttgattggaggatttagatcttttttacaattatttcaattaacggtagtagaaatatggagtgatatttattgtaaaaaagaataatgtgcatggtgtataattgtcatttagcaatgattaaatatttgtttctctttctggattttt

SEQ ID NO: 873 - DNA, 1500 bp, Oryza sativa
  Os01g01960 location: Chr1:522445-523944
gacctcgaggaactcctcgtatttctccctcttgtcctggaacttatccttgacggccttgaggtagacgagcgcatcgttcgtggtgagcttctggccggccgttgcgccgccggcgggcggctgagcaggcggagcagcggcggcctgaggcggcggcgctgcagcggaggcaggccccagaggcatgtgctgcggctgcgccgtcctacaccacgagaggaggggcaaacagttagatcaaaacgcaaaacaaaatcgcaccctaaaaaacacctcctttttttttgcgacgtagagttagaaattggaacacaaaatttgacggtgaagaagagagattccccaaaggaaacccgaattcctcccgcagatggaaataatatatataattaattattcactccctcgcgggctgagggtgagggaaacgaaaccgaagtgaagtttattttgaaaaataaaacaaacgaaataggcaggaacgcctggaagggcgaaggcgatgagcaccgaggaagccaaggatggaggaggcgaggagaaaagcactcacggatcggatcgaccgacgttggggcgcttgagttgggagcccatgagcgcgtcgtccctggcgcgcttcatccccccatacacagactcccttcctcctcctccccctcctcccttcacccaaccaaaccaccgccgcctcctacagaacaacctcccggtcgccgccgccgccgccgccgccgatcctctcaaacctcggaagacgtacaccggcgccggatctgcccgccgctggctcctgcgagaccccccgagcgcggcgcgaagagggcgcagcgcgaggcgaaggcgacgcgcggggaggagaggcggctaatcgcctcggcgagacgcgagacgcgagagggaaggatgggtgaggaacgaggcaagggcgaggcgaagaagaagaagagaagcgaggcctcctcttctctttaacacaacgaagagaagagagcgcatcacaacccatgtacacccaccggtgccaccacgctgccccgcgcccgtcgcgaaccacatcccgcccgcacatccccagataagggacacgtggacgtaccggatcgaccgccctagggtgcgaaatggttactggcggtgatcgcaccggtgggagggttagcttgtttcgtgggtaaacacaacctacccattggatttggggattccagtgagcggtctggattagcgcggggttacttcgagattagtgcccccgggcccacctgtcagtcggatgagtgcctccgatctcaggtttaacctagctccgctagggcggcgtcggttcgtatatccgcctcatgcgtgtgtgtcttctggctcaggagacgtatttccgtgggatccgtatatacatgggcttcatttggccatttgtcacgatccctagcttccagagagggctaccgctggatcttcagtttcatctgcagtatcaaactattaataaaaaag

SEQ ID NO: 874 - DNA, 1500 bp, Oryza sativa
  Os05g04990 location: Chr5:2418356-2419855
tgataacgatggtgcgccttcgtgatcgatcgagagcgtgaggagcaacgcggttcaatttatagacgatgcagatcaagctggtgccaagaagtggcgggaggttgatgacgatcgatcgatccgaggaagaagaagaagaagaaatgtaagtggtgatggtggtgatcgatcgagttgagttgagaggcggcatgcgcgcatgcatgaggatgagggggaggcaatggtaatgattgtgagcattatggggaggggagaggaggatcttggtgattaatgaacaacgttaatggtggaagtggtggcagtggggatttcgaatgagatttttctttttaacgattagcactagacaacacgactatgagaaatacccaagggtcatctggctagctctacaaggtggtaggccagatgatctgggttcaaagcctcgccccttttaattatttgatattagtctttttctaatattcatgtcttttactagacagtacgattattcatcgaatagaatatgaaaaaattacaagattaattagagacctagaagacaatagctaggaaagaagaaaaaaaatccaccaccacgcaccgacgtcatctacacacagccaaggagaaggtttagcaccggaccagtcggcgctaagcgtgaccgactgccgctaaaccaacaagggtatgggaatgaccgctaagattgcccaagtccaagctataacagccgagcatcaaacacaactctagccacatctataaaattgaggggaagaggatgagagagaagaattgaaccgctctctacgctaggccctctaacgtggccaatttgtttaaactagggcgccaccacaagaggatgagacatctaaagtgagcttgcaccagttatctatgataagatttgtcaagggggctttctagatgacgtctccagggacaggagcgacaatgacactgccgccaccatccgtcgaggtcttaaggagaactaagacaagattttcactcgataaccctacaagaggagaggggatggctcgacaacaccccgaagaagtaagatggcgcctgaagcgccagccaagaccgggctgggtttacacccgccgtcccgccacctgccgatcgaaagctgtgctccattgctacaaccaccatccatcctccgtcgcgcgtgggcaccgttgcaccgccggcccccgccggccaacctccatgcggcctcccactctttgcaccggacagttgtcaggccatcaccgtcgccgaccgccggcctttgccgctccgtcacccacgcctgccacaagccgtcggcctacgtcgcccgtgcccgtcgcaagccgctggcctctgtcgctgtctcctccggtctctagattcggcagcggctgtgccggatctaggcgcgggggagcgggggtggatgtggaggtgggggaggaaggggggcagatctggcagcggtggtgccggggacactatctcgag

SEQ ID NO: 875 - DNA, 1500 bp, Oryza sativa
  Os02g44970 location: Chr2:27240720-27242219
ggttgaattccacagggaaagctcatcatttacaattttctggaaaacaagtcttgactcagacagggcccctaaattagcataacaactcacaatcttagagccaagaatcacatcccagcacaatccatgtgtgaaaacatgacaatggatcttctttagagacctaatatctgcacagccttggaacaatggagcaaacttgtcaaaattaagtatcttattagagcatgaatttgcatcggcagtggatgctgatagtctccaacgcagcttcagcactgcaattttatcaaactttgaactagtgtttccagctaaattcccctcaaaagaattggtagcatcatcatggttgttgacgcaagaaaaacaaaaataggtaactaattgactccgaattcatagacatacgatgacagttcagttaaatgagcctacaatataatagtcccaagcacacatgtgtgagtcatgtgcaatgattacatcatgtgtgcttgggactattatattgtagactcatttaactgaactgtccaattgtggttggtgacatggttcaggagtctaacggtgtaccggaaacagatatagtgtatatctggaagtggagtctataaataggtccctaccctccagcctcataatgcattgtgagcggaacaacggaaaaggaatagagggtaggccggatagacccacgtaaacctaacaatatttgcttttcttgcacctccaaggatagactattcaactaaacctgatcaacagcggaacacatacaatcagtgtactttagtacaacagcactaaacttgatagcagatcacattaaattaagcgataatcccagttatggcatacacagcagaggagtgaagccacaatctctccaggacattgccacaggtaatgaatatgaaatactaccgcaatctcgccggtgctaccaaataaaccaccacctaatcagaacaaatagccacatcatcaagcagtcatcatgtaaaaacgagaaaatgggaaaactgaccaccagccgaaatctttttcagaggttcattccgtgaaagaaccggagtaggaggaggaggcctcggggtggccgccggcaagccgacctccggagggacggcgccaggaacagtggaggaggggcgcgcgcgtgggggaggcgcgggtggtgcggccgtgcgagggggcggcgctgccgctggctagtggagacatcggagttcggagcgaggagaggtggcgtggcgagacggtggggaatcgcgtgggcctttgcgcgtcccggagaaacggccgggtcgaaagcccacactaccattcggcttgggactagctatccatcacgcgacagatttttttttttccgaatcacacagattttatttttttttcaaatcacacagattttagattaattgaattaagctcatttgatcacttgattagaagagttatcaacatatattgcatatattttattta

SEQ ID NO: 876 - DNA, 1500 bp, Oryza sativa
  Os01g25530 location: Chr1:14470301-14471800 (reverse complement)
ggttgtagatgccagaaaaatgaatatgagtaactaattggcttcaaattcacaaacatgttttgcttttattgcacctccaaggatagactattcacctgaacccgatcaacagtaggggacatataatcagtgagctgtagtacagcaacacaaaaaatgatagagaatcacattaaaattaagccagaattccagttatgatgtacacaacaaacaagtgaagtccaggggcggatccaacttgggacatgggggttcagttgaacccccaaacttttgggtgaacaaacaaactgttattacctgaattatttaagagaggtttaaggctatcaaattaaggaggaggagaagatctagaagagaagctagtagggttcacgaacgcaagcaaattccagtcccggtggggtgggagagagagagagatgaatcagaaagaggacgcaccaggatcccctcccctccgctgcgatggagatcgccgcccggccctcccctgttcagccgcgactcgtcttggcggcggcgcaacgaggcaaggagcggaggagacaacgagaggtactcgactactctgcccttatctcaatatttttacttaccactctctacgtcctaatagttttacaaggttcacatccaacatttaactttttatcttatttaaaaatttgaaaattttttaaaaacggacggtcaaaagttcgacacggattttcacggctacacttattagggacaaggtagtattttaaaactagctagtgttatttctttatataactggtgacccatgtatcatcaatacttaggaaaaaattaaacgattgtgtcgacaacaaattcctcataccaccagcaaccgctaactgccactctacgcaccgccatcactgctctttctccatgaatcaccatcgttcttctcctttgcctttacatgcgcagccttaacctctagtaaccgacaagtctttttctcctcccctatcgtgatgcgcactattgttatcgttgccattgaggtcggagatgtcgggcttgcagggactttggaaggcaggagctgacccgacgaagaacgaaggcgctatatccgggctctttcttgctagatctatcggttatccaactgtcgtatggataaagaaaatggagagagagaaagagagagagttaatgtgcgaagtgattactgagtcaccggacttggagatggatagaatatggtggtctaaattaaaatgtaaagttagctattgtgtaaatgaaaatggttaaatgataccattatatgaaaacttttaagaatttttaagaatacatagtatggattgtaatttacttcctttgtcaaaaaaacgaatgtagaactggtgtggcacattctagtacaacaaatctgaacatatgtatgtctagattcgttttactaggatgtgtcacatccaatcctaggttagttttttatgggacgaagggagtacttttttt

SEQ ID NO: 877 - DNA, 1500 bp, Oryza sativa
  Os03g30650 location: Chr3:17474886-17476385
ctccgactctcttgtcttctctgcgtgtgcgcgcgtgttctgctctgtgtttgtgtgggagaaaggttccggcgttcagcgaggtttggaggtaggagtggggccctatttatgcactgattcgaatactactctgtattgtatttacggtggctaattgggattttcttggggtatttttataacgtacttctgtattttacggtgcctaataattgggatttgtttgaggtaggggtgaaaacggtacggaaacagacggaaaccatctttattgtttttgtttttattttatttttggaatcggaaaccccagatacgaaaacggaatcgaatattatcgaaaccgaaaacggagcgaaaacaaaccggcgcgaatacggtaacgaaaatttatcggaataaaaaacccctcaaactgataaatccaattgaataaattgtctatgtttaaaagagtaatgttgttgataaatcccaatataggaaaaaaatattcttatgtaattttagattcgcataacaaatatttttttaaaaaaataacagccaacatcattgtattcactatttagtgcttaaaaaaatacatggtatttcagtcacgaaatttttggtaattccggaaagtttccgaccgattccgagttccgatggaaactgcccttatcatttccgattccgtttccgagaaaatatttccgaattcgtttctgtttctgaaaaattccgaccgacagattccgttttcgaaaataggtctggaatccggaaagattccgtaccgttttcacccctagtttgaggtgataagctttgagatttacctcaagggtcccacgagcaggtgtagattctagaaacgggcagcgcccaggggggggggttgaaaagttcgttgaaggctgtcagaacaccatggaattgaggaattgcgtcaaactggaatgaacatgatgaacacccaagtactggcatgattagtccacttattattcaaagccaaaatggcgtaatggcgtacgtgaatggcgttgcaaaatcatccggactgcgactcgcgcgcggaagcctctgcctccgcggcgccccaacgccgcacgaggatgttctttttcttgacgtcgtgcctcatttcgagcgcagcgagttagccctgttttcccgatcaaaaactttttatcatgtcacatcgaatatttggatacatgtatagtctattaaatatcaaatatagacaagaaaaaacctaattacatagattgcatgtagattacgagatgaatattttaatcataattatgccatgatttggcaatgtggtgctactgtaaacatttgctaatgacagattaattaggcttaataaattcgtctcgcagtttacaggcggaatctgtaatttgttttcttattagactacgtttaatacttcaaatgtgtgtctgtatccttcaaaaacattacacccaaagaactaaacacaccctttgtattgtg

SEQ ID NO: 878 - DNA, 1500 bp, Oryza sativa
  Os01g64910 location: Chr1:37684066-37685565
ggcagcatgccttgccttcgatagttcgatctctagttagcggcaggcgcagtgcaggacagtgaactgattgcccaagttcttgcttgctgaggactggatgggagaagaatgtagtactagtacttcggaggaaaagagccaaagaaacgctcgtcatggctgacgaaacagttgaaggaatcaggtgattgatcgtgttcgtgtatgatacacggtgtatctggaattctggatccggctccgactccggctcctgtatctgtatatgtcaaaaactggtgtaaacgagatccctcgacggtttgaaagacagttttggctgacgtgatgcttacgtttttttattatttttccgggatcaaattgtcgcatatgcgccatgtcaatgttacgtgggacgaagtcctaatcaaaccagccacgcaaacgtcacatcagtcaaaatcgcctttcaaaccgtcgagggacttcgtttgcacagattttgacagttcagggaccggttgcatctgatttttggtttctaagaacgaaaatcggatttggtgtaaagttaagggatctgaaatgaacttattcatttctaatagggcacatcgccttcatttcaaatgggcctccatgtgccaggcccatatttcgattcgagtgtggcctccatggaccaattgagaaataagttcactttaggtcactcgtattgttggagagtctaatattcattccaggaccaattaaagtggcccatattgcggacgctgaagcccaaaggagttgctcctatggtgcggttggaatggtggatggctgaagatgcctcggaggtagagtagtattctctcattcccaaaataaactggagtaagagcatctccaatagatgactaaaattaaactcccaaaaatcatgtattggggacagccaaaaacatatttagcctaaaatacacccccttctccaagagaggactaaaatttgggagcgcttctagttgcccaatatttggttcaggttggtcctggttttggaggtggctaaattttgggaccatgcttaggagtctgttggagggctgattttcaccaaattcctaaaatttatgttttagtaacctgtttagcattctcttggagatgccctaactaccatctttaagggagtatctaaaacagtgataagtttttttttaaaaaaaatttagatataactatagtataattgatacgtaattacattgtaactatattgtaacataactatgatattggcatagtttggtggtttagtggtacgtgagcattcgacagatcgtgggttctcaatccttgaccactgcatgcattggttaattgttactccctccgtccataaaaaaaacaacctagtactgacacatcctaatactatgaatctagacatacatctgtccggattcgttgtactagaatgtgtcacatctagttctagaattgttttttaatgggacggagggagta

SEQ ID NO: 879 - DNA, 1500 bp, Oryza sativa
  Os07g26810 location: Chr7:15496040-15497539
gaatgatcatgtcgcgaagatctacggggcgacggcgaggcggtgaacgaggtcgttctgctcggcgctccctatgatgttcgggaggcgagtggacagatcgctcgtcgtgacccctgctcctgcgattagatcccacgccggcgatgctgaggcttggctgatgatagtcatgagatcggagatgggggactcggctgccagtcggcgtgcggacgcttccggagttaactgggaccgaagcagcaatcatggtcttggtctggttcaagatgttgaccacgtgatcagattgactgagcttgttctccttgaggagggtgtcgaggagggtgatcgcagcaacagcattctgttgtggggtgcggaaaaccggtgtcccctcaacatcttgctggccgataagatctcgcgctcggcgccctgcatctaaggctcattgccgtcggtcttcagcctccttagcggcccgctcgcgctcctgttgctcacgccgcagccgttcttgctcctgtgcttgacgctcctcctccagtcggcgtcgttcggcttcacgtcgcgcttcggcttctcgggcttggcgttgctcctccgtctcgttatttactcgatgagaggtaataccctactcctgtttggggatttaaatccaccgggtgtagtatagatctgacgatcatatgtgctcatgcccctagagggcctcctgcccaccttatataggatggggggcaggattacaagatagaaaccttaaccaatatagtatcggtttcctaaatttattttacaatattatcaaatcaggactttaggccgctccataatataaaaggaaacgtaatacccaagtcatgatctgttacatattccacagatataagctatcccctatgactagtcggataaccatgccgtgtgggtatggggtacccataatctccacagtagcccctgagaccttcacagtcgaaaagataatcttttctcgaactagattactccaaagccgagtgcttcaatcatcttcgccatgatctcccgagtacttttaccaaatatgaagactgtggagagctgaaaaataaagtcaggtgcaacgactagatgcatctaataggtgtagcccccgactatgtggttggctgaacaaactaagcatatagtcaaggaataaatgattcaaccaaccgagcggttttgataattgtaatcaaccaagtgacttgatatcaatatatagcatatgcggtgtgaatcccccaaataacatgatccaagtaatataccgactgctttgtaaaaattgatgcgagcaacttaaagttgactacatcattgaaaattcacatagcaaaacagctataaagaagcttgaatgttgcaaataaagtattgggcatacgccatgcgcacactgctttaacatatgtgcttaagttactaaaagacacatggtttcaccacacctggaaatatatggcatatgtggtgtaaaat

SEQ ID NO: 880 - DNA, 1500 bp, Oryza sativa
  Os07g26820 location: Chr7:15515227-15516726 (reverse complement)
agctgatgtagcgggtaggggagttgatgttggcgccgtcggctgaattgtggacgcaacggaggaaaccgcttgaacagatggctgaacatcggtgatcaaagatcgataattcgggaagacacctccttgcaagtaaactgggcctgtagcctgatgctcggctatcgaaccatcggctattgtcttcatcatgtttgacaatgtattgactaaaaccccggactgattgatcagagcatgatgcacagcgtaatcaactcgatcttgaaagttgttgaaaaaatcttgtgctagctcattattctgattaagatttccttcttgcggcccttgagcaccatcaccttgagccccacgcgctcctcgcagattgtcgccttgatcgcttggggagccgtcggtagcacctttagtactcggctgagcgtgtatcggctaatactccgataccactctatatcaggatattaaagcaggtataatatatcaaacaaaagcctaacatatttagatacagcaatatcttgatataaagggcagatttagcatatcaatgagacatatagaataaatatggctaaatcagatacgatcggctgaaactccaatgctattctaatcggcaactagaaggcaggctagagatcgatattctaagcacgacttaatagatcaaactcaacttatgcagcattaagtatgaaaagaagaacgatatctagacaatcaagccgctagcagttccatagaatggtggatatcttatatgatctagatcaacgtcaagatctaacctaatcggctgccttctgcgtacagatattggccgatagtagattagatagcgatattgttagagattatataagatatatgataactcgacgaattacataaacaagattagagtgtcatgaagatggaagcactaatcccgagaacgcaagccgtcataacaagttttacctcttgttgaatattgaaatcgatgcagctcaacccgaaagcaagaacttgtcgaaacaaaactaaagcaaaaagggtggcgatgcgccgagattgtattggacgtgtgtgttaaaaaattacatagggcccggggtctatttatacccgagaattacaagatatgcccataccggacacgaccattatctctaacaaactccaagataccataagtctttgcggcagatttttgcccacacttatctataaggaatttacataaaatatcctaattaatagatacaattgccttcccaggactctatccatgtatggcaatcatcttgaagtacattaacgtgaacccgatgtcgcgatcaagccgtattgtcggaatcggctgtatcggcttatttagctcgactcagacccagccgatcttaaccgtagccgatctggactccagccgattcctgctcagccgattcctactctgtttccgaactcgatctccgcctccgactccgctttgatcaaatcctctttcct

SEQ ID NO: 881 - DNA, 1500 bp, Oryza sativa
  Os09g11220 location: Chr9:6225987-6227486
cgggctagctacccccttatcaagagcctccacctcatcggctcatcccattctcttcctcacctccccctctcttctctttcgtgatccctcttcctcctcctcctctctctctctctctctctcacacacaccaattccacctcaaaacgcatgaatatagatgatgggttcatttgtatggccgtatgaagtttacaatgatccctgtattttctatcttccttatcatccttatccaaagctcttgctcgatgtctccgattgtgttcttcaaaaacacctacttattgtttgattgctttggtcttttgtgaagcaaaataaaaaagagcttgaagtggataaaatttttcccatgccttcccatgaaatcagtagcgaaggaatctttccttctatttttcgtacggctggtgtgttccatctcctccagatcctcggacgtagcactcgctacgtcagagggacatccggcgcagctgcgtcgttcataccgcatcggatgaacgcacgcagtgaggcggccaaacgggctcaaactcggtccaagtcactgaaataggacggctcatttgaacagaaggctcgtttccttagccagaaaaatcggtgtcgctcccaagttctccaggacatcagccggcggccgctcatcgtctcctccggctcaggcgctattggagccgatctcggacaaagcccctcccctcgtcgccgccctcctcaccatccctcgactcctcacgtggcgcgatgtcacgccctgaagttttccccctttttcttgctttaaaaatttgtttaataaattgcctcaagaaataatttgattaacctagagctaattccttaattaataaatgcaatcaataattggaaatggcattgtgggatttttcttgggttccacttgtcacatttcattaacgggatttttagtagaattttcatagccctataaatagttttaaccaataaaaatcaattatccgcaatattctaatcccaggaaaatccttttctttttcctcttttttcttttcctcctttttcctcttcttgggccatcggcccacttggctcctacgctgcccgctcggctgggccggcccacgccccatccctcctctctgggacgccgataggtggggcccacctgtcaagtcgtcccctacctctagccgggcagcaaccgccgctgaaaccgcccacgccaccaccgttcccgctctcctccacgccaccactccacaccagtgccccacgcccacgtcgcccgcccactaacccgcttctcccgctcgtgcgtgcgcccgtgaggggcaggattcaatttgaatccccccctctctctctcccccacctccccacgtcgccagccaaatcgggccctttcccggccgtgtccgcctctcccaaacccctatatagcttccctgcgtcctcctctccatttttcccctttccacctccctctcccgtgacctctatcgcacc

SEQ ID NO: 882 - DNA, 1500 bp, Oryza sativa
  Os04g21800 location: Chr4:12352409-12353908
ggtgacgggtttatgacgacagcgggttgcaggtgcgatgatcgtccttcctctcctctctcctccactttcccccggttgcttggctagtggattgtcgggtcccaaaactaatgattcggtaaccgacatgtttagactgtatcaagccctggatcagtagattgatacaggttcaacaatctggatctttattgtatacattttaataaggctccaaaggagatattgttattaccaaatatatgggtatttacaaacttgtggccaactaatacaacagaagctatagaatgaaccaactctaatgttttgcgtagagttaaaccatcaatctaatctatacttgaaaactaaactaaattagaatgagactaacttatatgattgaactcccagcttcggcaaaaactccgaaatgactctgaaaaaggtggggttgaagcaagggtgagtacaacgtactcagcaagctattatattcaatatgaatgtatgaaatagtagcatttgagtagggctagatttacttgcagaaagcagagaatgcagaagaagtgagcctgtaatgattttaatgcaacagtatttaataaagtttggaattaagtttctaaccaaataccatatgagtcccaatgctcaaatccatgagcacggctattcgaatagattcgttttcactttactgcagtaaatgtatgctttacccatagcccacgacgtgacgataatcatcagctttagtcatggcccagcattaggttattaacaatagtggcacctgtttcatgaactctagtccccatgcgctctgaacgtacgttatcagcagcgtgaggagttctggcgttcctggggtatttagagaggactgattgtatgacaccatatcatcgcaatcagggtttacaaacagttcgtgatatcacaatttatctcaaatatttacctatgcctcggtaaatatcacaatattgccctgctcggcataagttttcctcctgcgcgaggacttaaacaagaaccactatacagaggtaccaccttgttaaataacataataacttggtctgtccccatcctagaactgtggtcgtactcgtttgttcttcataagtacttggcagtcttatgtcggttggaacagtactagccacccggaaaatcaaccatttctaccgtaccgttcaaatctaagtttattatatttgtatgcagtctaactaggcatgactaagcaaagctagcatatatctggtttgctatatgttcatgatatgcattcaaaatcatgaagagctaatgcatagaacagaaataaagaatatagggcatttatgctcaaaggagaggaataataacttgccttgctccaatgcaaataaatccgagataggcaacctgattatctgatccttgaaatatcacaagttgccatctaaatataatagactctactggagaagaggaagaaccaaattcaataaaaatcatgaa

SEQ ID NO: 883 - DNA, 1500 bp, Oryza sativa
  Os10g23840 location: Chr10:12223468-12224967 (reverse complement)
gacctcgccccagtgggcatgccaaaaacctcacacccgacacggcaccactttacttaccaagctcaagaacacccaacgtaacgagcagacgcgcagggcagatcaaatatcaccggtacgaaatctgagacaggatagctcatgcggattatgcgtctaaacagctcaacttgcaacgacaagctgatacgcgagctcagctcatagcgataaccttttttttacggggagtaccgatagctgatgcggcgtcggggactcggggcaacgcaacctgatgcgaacaagcgaccgagaaagagaaacatcacataccaaaattacccctaatatatattaagagattactaatctaccctttaaaatatacggttgagattaattctacttgcagtagaatactgcaagtagaaagcaccggagcgtcaccttaaagccaaataatgccttctgaaatctcatgtacaactagaagtagaaaatttctagtggaaatcttgcatccgtggttctatgaatcttgttatctacagtgatcaatcgatcaatcggataacctgttctttgatgaatcttcttgagtttttatcggatggaatttgctgggattgctttgaattcgtgcacaacgccgtcgatctcgatgaggctgcagccggggaccttgtcgatctcgttcctcctcatggcgtcgagttgctggagcccctcctcgatgagtccggcatgacagcacgccgtgaggacgccgaggagggtcacctcgttcggcgtcacgccggctcgttgcatgctggcgaatagagacagggcatcctcgccgcggccgtgcattgcgagacccaggatcatggatatgtaggtataccggcgagacccagcgaccagcggccgcagcaagcctcgtaccggccagcgttcaacagccttctcgcgcacggccacatcctgctcgcgctccgcaccgccgttgccggccttgcgcgcagccgcctcctgctcacgctccacgccgccgtcctcgcgctccctccccgaccgtgtccgcatccgcgccattggtcgctcctggcgcgcggtcgccgctacccgctcccttgccgtggacaacctcgtcggcggcggctgctccctgatattttttttttttggtgtgattcaggtggagaaagatggagccaggggcaatcttgccatttcgaaaaatttctcacctcttttgacccggatattataaaatattgtcttcggtgtcctatagctaattacataatttttgtagtgtccatcagccgtgtctcgtttttgcggtgtctctcagccaattacacgttttttgagtgtcctatagcaaattttgccttcttcgaacggcgggaagaagtttgctttgtaatctatatagtcaacacatactaagtttgatcgtaatcattgcttacacaggatttggtcacatttatgaaaatgacaatatagccatatttgttaaacaaa

SEQ ID NO: 884 - DNA, 1500 bp, Oryza sativa
  Os08g13850 location: Chr8:8268007-8269506 (reverse complement)
gacctcgccccagcgggcatgccaaaaacctcacacccgacacggcaccactttacttaccaagctcaagagcacccaacgtaacgagcagacgcgcagggcagatcaaatatcaccagtacgaaatcgagatgggatagctcatgcggattatgcgtctaaacagctcaactcgcaacgacaagctgatacgcgagctcagctcatagcgataaccttttttttacggggaataccgatagctgatgcggcgtcgggggctcggggcaacgcaacctgatgcgaacaagcgaccgagaaagagaaacatcgcatatcaaaattacccctaatctgtattaagagattactaatataccctttaaaatatacggttgagattaattctacttgcagtagaatactgcaagtagaaagcactggagcgtcaccctagttgtaaatgggcaccattctttgattctctcgtgatgcatatatacattacgaagaatgtcaaaatataactactggtgtgaacatgaagttatggttgtttggtttcattcatcaaggttcaaatctttatgtccatatacacatctcgcatgtgtattttaattggtgcagagaggcggtcattctatttctcttgttaaaaaaaaaaatcaaactataaccatgtgttcgccatgctttataccttccatacaaaacttgggtcataaatgtgagctgccaaagtgatcttaatggtttagaagtaagttgcttcctaacatggctccattatagaagaagaaaacaatgtttcattcatctcctttaaaccaagatgaaattaagaagccctcttcctagttgcgggccaggaagcgactaaccatttgtggacaagcacagccaagtaaagccccaaatctcatattgttgtaggacaagataaggttgacaacacacccaggttttgtccatgttgatgatcaattagtttggttgttcaactgtcccgattaacatcttcaaagcaaagcttccaacagaccaacagtacattgaatgaaccgaacaaaacagaagagaatagatggtttctttgcatttaagttttattgtaccacttcgactcatttgtattcaagttttacgaaacttcttgattaactgaaaactgggctaggtatacttagcccgaccaatcagatatgacttttcacccttcctttttcaccaattaactaggaaagtatcccgcgcatgcattcgtgtgcggggatgcatatattagtttgtttcaaaaacacatcaaaatctaaattaaaagtaagatgttttcctttattctaattgaatgttcattggcactctttctttccataagcaatctcgatttttaccgctgatgaatgtattttattataatgtcaagctggacatccctctaataggtttaattgcatatagtttacaaaattggaggaaatatcatctcggtgatatttgacaccataaaatatgatg

SEQ ID NO: 885 - DNA, 1500 bp, Oryza sativa
  Os12g42980 location: Chr12:26703270-26704769
ggtttgccagaaggcagcaacgagagagagaggcgatcgaattcagtgagctgtggcgtaattgcccaagccacagctctctctctccctctctctctctgcctataaataagtgtttgcagctacgaaaattcaatcggggaaaaactatatgggattatcctattgatttatttatggtatgcaggatatggaggcttcgcaaattcgtttgttgtcgcctgtgggacatcgatatcagagtagaattgtttaggctcgtactccctatgtcaaaaaaaaaacccacttctataaatgaatctggacatacacggacatagtgtatgtccagattcgttttttttacgaagagagcacaacatatgtctattgtcgatacttttttgagatcagtatataaaataggtggtactagattaacgatgggctagatggttaataatgagcatatatgtgcaatagatgaaacatgtctatacaagtatagtggtatactgctacaggtaatttgttactatgtgtcagttcaattgtacagttttaaatattattactactatatcacaatatgatacttgagtgtttttactatgggagactcccctgctgtgttttggttaagagtgagcccttctcatatgagtgattcttactctcccgtcccaaaaaaaactcaacctaggaggggatgtgagacaacgaatctggataaatggtagtccagattcattgtactaggaggggtcacatcccctcctaagttgagtttttttttatggaggaagtatactactccctccgtttcaggttataagactttctaccattgcctacattcatatatatatatatatatatatatatatatatgggttagaaagtcttataatataaaacgaaggtagtactgtacatatgattgggtatgggtgtttcttataattgtgactttcagataataaaataatatcccatgttttttttaaactaaataatatccgatgtttttattccattatcataaggaaaaaaaatcccatgaatgatatcattgccggcggttgcctgtggcatgcaagcagttggcagattcttctcgtctcacagcatattgtcccttggcccttgggcattccaaatttctaccaataatttcattctaagaactaaagtcgacgtcgccatcccggtgcacgcacgccggccatgctagcttgcagatagaattggaatagttagccaagccaactccaaccaaagaccctacacatcaccatcctatccgttctacacgatgaaatattcactccatttctaatatacgttgtcatcgatttgtagtgcgtgaacagtgattttattaaaaaaatgtaaatataaaagaatatatgtaagtcatacttaaagcagctttaatggtaaaaataaataacaacaaaaaatattattattattacatattttttcagtaaggttaaagataaaacatgtgtacag

SEQ ID NO: 886 - DNA, 1500 bp, Oryza sativa
  Os03g29280 location: Chr3:16670214-16671713 (reverse complement)
cgtggcctgcgaccgcgagtggtcagtgtgtccttctgtgtatagttggaatcttttcgatatacttctgtgtatagttagagtttcgaggggcgagttgaaaccttaaaagacgtaaccagtagaaaaaaaaacaaacacaccaccatcataaagtagaaaaaaaaacaaacacaccaccatcataaactagcaggtcctcgcacaacaccctaaagaaaactctaaagtgttgtgcgaggacttactagtttatgatgataaactagtaattcctcgcacaacaccctaaagaaaactctagggtgatgtgcgagggcctgccgttttatgaaggtggtgtgtttgtttttttttcctactggttacgtcttttcaggttatgatattatagttatttcctgttatatccgtacgaacttcgcgctatctaaatataaatcgtaaaaaaatatatactccctccgtttcaaaatatttgacacgctatttattaccatggctagcaatgattttaaaattgtggcaacatgtatttattgctacaattttagtattgatgccacgatttttttcgtggcaacaaatgatttttctagtagtgattgtcaaatgtaataaataaagggttgtgttgatagttatcaagtggtgttttggtggcaaggtgccagggtgcttgaggttagaccggcgtggtaaggcgggtcagattggaagtgtttgtgcggtcagaccggccggatagctgtggtctaaccataggtgtttgagcggtcagactaggtagcccgacagtgggaacgatatactcctgtttggagtcggtatcttgttgattttatggaacatgttgattgcttaatgtttattacttctagtttgtttctatacgtgagatatattgtacgttgtgtaccattgttgagtcaagttgataaaaaaacttgtgcttggatatagtttcttagtttgttcatgtgtagttgttacttgaggcctcgggagtattgccggtgatgaatcgagactaagcttgggaaaagttgaggtctagatggacaagaagatcatgcatgatactaaggctagagaacaatgcacgtagagataaagtttccatatggcatgcaagaagagttttgtgcgtatgagaagtggagtcaaatttagattggagtccaagtttaggaagattagagattgaagatgtacagggatgtgtatatccttgttttgagaagtttcctatgtaattaggattccttgttctagttggattcgtggcatgtttgtcggtataattagatgaggggtcgaggctcaaagtaaggtgaagtgggcaacttttaggagagaaaagttaggtttctttttgagatttcggttctagttcgtgaattgagaaaggaatgctttatattccctttgtaagtataacttgatacaataaagtttatccacttttagatgccctttgtaagttaggtttgtgttttt

SEQ ID NO: 887 - DNA, 1500 bp, Oryza sativa
  Os03g20650 location: Chr3:11684335-11685834
tgcctgagctcccatccaccccacccccaaccccacgcgcgcgatcaccaccacctgcgacacacacaaccccgagacgcaccccccccccccaaccctcacgatcaaacaatcaaacacctgacctacgccgcagcaacaacaacgacaacaaccacaaaccacccacacaaacagagcccacactgaccctcgtccctcggcggcggcgcatggcaagaagaagcagagaggagagtggaggtggggaggaggcaagaatttaggattccacaaaggggggtggtgcgcttgggccaatgggggcagacaggaggcgatgcccctctctccctctctctctctctctctctctctcgcttgggaagaatccaaaaagcgatcgacgaggcgagaagcgaaagacgagtgcgtgcgcctgtgctgtgcgtctccgcgcgcgcgcggtgctggaaaagaaagaaagaaagaggcgctgcctttctagctctgtgaccaaggttcgctttgcctttgcctttggtgggcagagggagagagagagggggggttttattcgcgggggagatggcagctgcagaatctgcacaagagagacgggggccaatgtgacacaagagatcaggttattcaggtactcccgccacatcagtctaaggccccacgtaacagtcgcagcgtcactgctctctccaccgcggtgattttttttatttaccgctcacgaatctttttgagtactggaattcggataacaaacgcactcaaacgacgagtactatgttattcctcccttcctacatcgtataatacaagagattcggataagatgtaatatttttcagtactagaatgtgtcacctctctaaattctttagtagcatgaatatgtatatactatttgtccatatttatagtaataaaaaatatgatatccggttctggattattgtattttgagacagatgaagtagttaaattttaaggttttataagaatttattaaaaaaggtattgtttgatagcactatagtaaaagcgcaggaatttgagacggaataaagagaaaacatgaggtctgtttttgtaggagatatttctttgtattccatatgcattcggagccatttctttgtttcagagaatatgaagctagggatctttttccaactaaatttcaattatccaaaattcctctttttttgctgttctaaaaggaacctttaattttatagtatttttcatcgcaagaaaaagttataagtgcgttgttatatgttttcgagaataccgaatttgatgcacaacgggttgccacagaagattcaggtcctaggtgtgtcttcagttccgaatctaatacgagtggctgcctgtactactgcctccctttcacaatataagtcattttagcatttttcatattcatattgatgttaatgatcaatatgaatataaaaaatatagtattttctatattaatattgatgttaatgaatt

SEQ ID NO: 888 - DNA, 1500 bp, Oryza sativa
  Os06g43920 location: Chr6:26453545-26455044 (reverse complement)
tatgcaatcaaagaagagatgttgaattgactcattagagttacaaaagctacaaagcaagctacccttccatcttcttttaacaagattatcttttgttagaatcacccccttttcaatataccaaaggaaaattttaatttttaaaggaatccttagcttccaaattaaagatttcctatgtattacaccattaagcataagggctttatacatggagttaacataaaacaacccttttttattgctcttgcaaaagaattggtcttgcttatcattcaaattgacactcaccacctttgaaacaatttcaagccaatcttccaagtttttccctacaattgctcttctaaaagaaacattcaaagggacccttcctaacacatcggccactaccaagtttttccctaccattgttttcatctagttgatcaaaaagatcttgctgatcaactgtgtcatcgagcacagggagaagaatgccatcttcatccccaccattcagcatctgagccggcatctcagggctgtcgagatgaaagtcaggaaatgtagaaccgaagcttgaatcagttggtgttgaagaactgatgttcgagtcactaccaagtgagaagttgtcatgcatcatctctgctgggcttgtgtcgtttcctatgttgaatgaccccatctgatcatcgaaatctgacagtgatatggtgctcatgattggtgacatttgaccatgtagttcatctccaaacatcggttcctggccactggaggctgcaaagcttgagagctggttgatattggcgatgttcgcctgcgacgggcggaaagatgtcccatcattgtgaccaagatcaggaaacatcgatggtgctgtaggttgccagtatttgctacagtttgcaaggtccggaaattggtaatcattgccaattgtgctgaagtggtttgtagaagattgattcatctgaaccaaaggctgattattcacttcagggtactgcactggaaactgatttgttggcgccaaaaactcaccatttgactgcactggaaactggtttgcaggcaccgaaaacccaccatttgactgcacttgatactgatttgcaggcgccgaaaacccacaatttgactgcactggaaactgatttgcaagagctgaaaacccaaactttgactgtacttgaaactgatttgcaggcgccgaaaccccattatttgacttgtttgcagacgagttgccagaatggcaagatggagagccattgcttgtctcccacatactcttacagaacatgccagcatatgagctaccagaatcgtctgtatccaacaccaagccatttgatatgtttgcaaatgagctcccagatgggccagatgggaagcactttcttgcatttgatgagttctgcagtggctgaaacacaggattgttgcccgggcttccaccatggccaactgtccccatggccatgtttctctggctgttcttgagctgaa

What is claimed is:

1. A transgenic plant having greater photosynthetic resource use efficiency than a control plant;
    wherein the transgenic plant comprises an exogenous recombinant polynucleotide comprising a photosynthetic tissue-enhanced promoter which is operably linked to a nucleic acid sequence that encodes a polypeptide comprising the amino acid sequence of SEQ ID NO: 2;
    wherein the promoter regulates expression of the polypeptide in a photosynthetic tissue to a level that is effective in conferring greater photosynthetic resource use efficiency in the transgenic plant relative to the control plant;
    wherein the control plant does not comprise the recombinant polynucleotide; wherein the promoter does not regulate protein expression in a constitutive manner; and wherein expression of the polypeptide under the regulatory control of the promoter confers greater photosynthetic resource use efficiency in the transgenic plant relative to the control plant.

2. The transgenic plant of claim 1, wherein the photosynthetic tissue-enhanced promoter is an RBCS4 promoter as set forth in SEQ ID NO: 863.

3. The transgenic plant of claim 1, wherein the transgenic plant has an altered trait, relative to the control plant that confers the greater photosynthetic resource use efficiency, wherein the altered trait is selected from the group consisting of;
    (a) increased photosynthetic capacity, measured as an increase in the rate of light-saturated photosynthesis of at least 10% when compared to the rate of light-saturated photosynthesis of a control leaf at the same leaf-internal $CO_2$ concentration, with measurements made after 40 minutes of acclimation to a light intensity that is saturating for photosynthesis;
    (b) increased photosynthetic rate, measured as an increase in the rate of light-saturated photosynthesis of at least 10%, with measurements made after 40 minutes of acclimation to a light intensity that is saturating for photosynthesis;
    (c) a decrease in the chlorophyll content of the leaf of at least 10%, observed in the absence of a decrease in photosynthetic capacity;
    (d) a decrease in the percentage of the leaf dry weight that is nitrogen of at least 0.5%, observed in the absence of a decrease in photosynthetic capacity or increase in dry weight;
    (e) increased transpiration efficiency, measured as an increase in the rate of light-saturated photosynthesis relative to water loss via transpiration from the leaf, of at least 10%, with measurements made after 40 minutes of acclimation to a light intensity of 700 µmol PAR $m^{-2}$ $s^{-1}$;
    (f) an increase in the resistance to water vapor diffusion out of the leaf that is exerted by the stomata, measured as a decrease in stomatal conductance to $H_2O$ loss from the leaf of at least 10%, with measurements made after 40 minutes of acclimation to a light intensity of 700 µmol PAR $m^{-2}$ $s^{-1}$;
    (g) a decrease in the resistance to carbon dioxide diffusion into the leaf that is exerted by the stomata, measured as an increase in stomatal conductance of at least 10%, with measurements made after 40 minutes of acclimation to a light intensity of 700 µmol PAR $m^{-2}$ $s^{-1}$;
    (h) a decrease in the relative limitation that non-photochemical quenching exerts on the operation of PSII measured as a decrease in leaf non-photochemical quenching of at least 2% after 40 minutes of acclimation to a light intensity of 700 µmol PAR $m^{-2}$ $s^{-1}$;
    (i) a decrease in the ratio of the carbon isotope $^{12}$C to $^{13}$C found in either all the dried above-ground biomass, or specific components of the above-ground biomass, leaves or reproductive structures, of at least 0.5‰ (0.5 per mine), measured as a decrease in the ratio of $^{12}$C to $^{13}$C relative to the controls with both ratio being expressed relative to the same standard; and
    (j) an increase in the total dry weight of above-ground plant material of at least 5%.

4. The transgenic plant of claim 1, wherein a plurality of the transgenic plants have greater cumulative canopy photosynthesis than the canopy photosynthesis of the same number of the control plants grown under the same conditions and at the same density.

5. The transgenic plant of claim 1, wherein the transgenic plant produces a greater yield than the control plant.

6. The transgenic plant of claim 1, wherein the transgenic plant is selected from the group consisting of a dicot plant, monocot plant, corn, wheat, rice, *Setaria, Miscanthus*, switchgrass, ryegrass, sugarcane, miscane, barley, sorghum, turfgrass, soybean, cotton, canola, rapeseed, *Crambe, Camelina*, sugar beet, alfalfa, tomato, *Eucalyptus*, poplar, willow, pine, birch and a woody plant.

7. A method for increasing photosynthetic resource use efficiency in a plant, the method comprising:
    (a) providing one or more transgenic plants that comprise an exogenous recombinant polynucleotide comprising a photosynthetic tissue-enhanced promoter operably linked to a nucleic acid sequence that encodes a polypeptide comprising SEQ ID NO: 2;
    wherein the photosynthetic tissue-enhanced promoter regulates expression of the polypeptide in a non-constitutive manner; and
    (b) growing the one or more transgenic plants;
wherein expression of the polypeptide in the one or more transgenic plants confers increased photosynthetic resource use efficiency relative to a control plant that does not comprise the recombinant polynucleotide.

8. The method of claim 7, wherein the photosynthetic tissue-enhanced promoter is an RBCS4 promoter as set forth in SEQ ID NO: 863.

9. The method of claim 7, wherein an expression cassette comprising the recombinant polynucleotide is introduced into a target plant to produce the transgenic plant.

10. The method of claim 7, wherein the transgenic plant has an altered trait, relative to the control plant, that confers the greater photosynthetic resource use efficiency, wherein the altered trait is selected from the group consisting of:
    (a) increased photosynthetic capacity, measured as an increase in the rate of light-saturated photosynthesis of at least 10% when compared to the rate of light-saturated photosynthesis of a control leaf at the same leaf-internal $CO_2$ concentration, with measurements made after 40 minutes of acclimation to a light intensity that is saturating for photosynthesis;
    (b) increased photosynthetic rate, measured as an increase in the rate of light-saturated photosynthesis of at least 10%, with measurements made after 40 minutes of acclimation to a light intensity that is saturating for photosynthesis;
    (c) a decrease in the chlorophyll content of the leaf of at least 10%, observed in the absence of a decrease in photosynthetic capacity;
    (d) a decrease in the percentage of the leaf dry weight that is nitrogen of at least 0.5%, observed in the absence of a decrease in photosynthetic capacity or increase in dry weight;
    (e) increased transpiration efficiency, measured as an increase in the rate of light-saturated photosynthesis relative to water loss via transpiration from the leaf, of at least 10%, with measurements made after 40 minutes of acclimation to a light intensity of 700 µmol PAR $m^{-2}$ $s^{-1}$;
    (f) an increase in the resistance to water vapor diffusion out of the leaf that is exerted by the stomata, measured as a decrease in stomatal conductance of at least 10%, with measurements made after 40 minutes of acclimation to a light intensity of 700 µmol PAR $m^{-2}$ $s^{-1}$;
    (g) a decrease in the resistance to carbon dioxide diffusion into the leaf that is exerted by the stomata, measured as an increase in stomatal conductance of at least 10%, with measurements made after 40 minutes of acclimation to a light intensity of 700 µmol PAR $m^{-2}$ $s^{-1}$;
    (h) a decrease in the relative limitation that non-photochemical quenching exerts on the operation of PSII measured as a decrease in leaf non-photochemical quenching of at least 2% after 40 minutes of acclimation to a light intensity of 700 mol PAR $m^{-2}$ $s^{-1}$;
    (i) a decrease in the ratio of the carbon isotope $^{12}C$ to $^{13}C$ found in either all the dried above-ground biomass, or specific components of the above-ground biomass, leaves or reproductive structures, of at least 0.5‰ (0.5 per mine), measured as a decrease in the ratio of $^{12}C$ to $^{13}C$ relative to the controls with both ratio being expressed relative to the same standard;
    (j) an increase in the total dry weight of above-ground plant material of at least 5%; and
    (k) increased yield.

11. The method of claim 7, wherein the transgenic plant is selected for having the increased photosynthetic resource use efficiency relative to the control plant.

12. The method of claim 7, wherein a plurality of the transgenic plants have greater cumulative canopy photosynthesis than the canopy photosynthesis of the same number of the control plants grown under the same conditions and at the same density.

13. The method of claim 7, wherein the transgenic plant is selected from the group consisting of a dicot plant, monocot plant, corn, wheat, rice, *Setaria, Miscanthus*, switchgrass, ryegrass, sugarcane, miscane, barley, sorghum, turfgrass, soybean, cotton, canola, rapeseed, *Crambe, Camelina*, sugar beet, alfalfa, tomato, *Eucalyptus*, poplar, willow, pine, birch and a woody plant.

14. The method of claim 7, the method steps further including: crossing the target plant with itself, a second plant from the same line as the target plant, a non-transgenic plant, a wild-type plant, or a transgenic plant from a different line of plants, to produce a transgenic seed, wherein said transgenic seed comprises said exogenous recombinant polynucleotide.

15. A method for producing and selecting a crop plant with greater yield or photosynthetic resource use efficiency than a control plant, the method comprising:
    (a) providing one or more transgenic plants that comprise an exogenous recombinant polynucleotide that comprises a photosynthetic tissue-enhanced promoter operably linked to a nucleic acid sequence that encodes a polypeptide which comprises the amino acid sequence of SEQ ID NO: 2, and wherein the photosynthetic tissue-enhanced promoter does not regulate protein expression in a constitutive manner;
    (b) growing a plurality of the transgenic plants; and
    (c) selecting a transgenic plant from the step (b) that has greater photosynthetic resource use efficiency than the control plant, wherein the control plant does not comprise the recombinant polynucleotide; and wherein expression of the polypeptide in the selected transgenic plant confers the greater yield of the selected transgenic plant relative to the control plant.

16. The method of claim 15, the method steps further including:
    (d) crossing the selected transgenic plant with itself, a second plant from the same line as the selected transgenic plant, a non-transgenic plant, a wild-type plant, or a transgenic plant from a different line of plants, to produce a transgenic seed, wherein said transgenic seed comprises said exogenous recombinant polynucleotide.

17. The method of claim 15, wherein a plurality of the selected transgenic plants have greater cumulative canopy photosynthesis than the canopy photosynthesis of the same number of the control plants grown under the same conditions and at the same density.

18. The method of claim 15, wherein the selected transgenic plant has an altered trait, relative to the control plant, that confers the greater photosynthetic resource use efficiency, wherein the altered trait is selected from the group consisting of:
  (a) increased photosynthetic capacity, measured as an increase in the rate of light-saturated photosynthesis of at least 10% when compared to the rate of light-saturated photosynthesis of a control leaf at the same leaf-internal $CO_2$ concentration, with measurements made after 40 minutes of acclimation to a light intensity that is saturating for photosynthesis;
  (b) increased photosynthetic rate, measured as an increase in the rate of light-saturated photosynthesis of at least 10%, with measurements made after 40 minutes of acclimation to a light intensity that is saturating for photosynthesis;
  (c) a decrease in the chlorophyll content of the leaf of at least 10%, observed in the absence of a decrease in photosynthetic capacity;
  (d) a decrease in the percentage of the leaf dry weight that is nitrogen of at least 0.5%, observed in the absence of a decrease in photosynthetic capacity or increase in dry weight;
  (e) increased transpiration efficiency, measured as an increase in the rate of light-saturated photosynthesis relative to water loss via transpiration from the leaf, of at least 10%, with measurements made after 40 minutes of acclimation to a light intensity of 700 mol PAR $m^{-2}$ $s^{-1}$;
  (f) an increase in the resistance to water vapor diffusion out of the leaf that is exerted by the stomata, measured as a decrease in stomatal conductance of at least 10%, with measurements made after 40 minutes of acclimation to a light intensity of 700 μmol PAR m $m^{-2}$ $s^{-1}$;
  (g) a decrease in the resistance to carbon dioxide diffusion into the leaf that is exerted by the stomata, measured as an increase in stomatal conductance of at least 10%, with measurements made after 40 minutes of acclimation to a light intensity of 700 μmol PAR $m^{-2}$ $s^{-1}$;
  (h) a decrease in the relative limitation that non-photochemical quenching exerts on the operation of PSII measured as a decrease in leaf non-photochemical quenching of at least 2% after 40 minutes of acclimation to a light intensity of 700 μmol PAR $m^{-2}$ $s^{-1}$;
  (i) a decrease in the ratio of the carbon isotope $^{12}C$ to $^{13}C$ found in either all the dried above-ground biomass, or specific components of the above-ground biomass, leaves or reproductive structures, of at least 0.5‰ (0.5 per mine), measured as a decrease in the ratio of $^{12}C$ to $^{13}C$ relative to the controls with both ratio being expressed relative to the same standard; and
  (j) an increase in the total dry weight of above-ground plant material of at least 5%.

* * * * *